United States Patent 12,508,308 (INFLUENZA mRNA VACCINES) - sequence listing, part 11

SEQ ID NO: 43192 - RNA, 1710 nt, Artificial Sequence
  hemagglutinin__InfluenzaA__AIM55926
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguaucaucauuucagauacaccaguccacgauugcaauacaacuugucagacacccgagggugcuauaaacaccagccucaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcaaaggaaauuggaaacggaugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43193 - RNA, 1701 nt, Artificial Sequence; identical to SEQ ID NO: 41497
  hemagglutinin__InfluenzaA__AIM55937

SEQ ID NO: 43194 - RNA, 1701 nt, Artificial Sequence; identical to SEQ ID NO: 41525
  hemagglutinin__InfluenzaA__AIM55948

SEQ ID NO: 43195 - RNA, 1701 nt, Artificial Sequence; identical to SEQ ID NO: 41507
  hemagglutinin__InfluenzaA__AIM55962

SEQ ID NO: 43196 - RNA, 1701 nt, Artificial Sequence; identical to SEQ ID NO: 43190
  hemagglutinin__InfluenzaA__AIM55984

SEQ ID NO: 43197 - RNA, 1701 nt, Artificial Sequence; identical to SEQ ID NO: 43189
  hemagglutinin__InfluenzaA__AIM55995

SEQ ID NO: 43198 - RNA, 1701 nt, Artificial Sequence
  hemagglutinin__InfluenzaA__AIM56017
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggacauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacgaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcaaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43199 - RNA, 1701 nt, Artificial Sequence; identical to SEQ ID NO: 43198
  hemagglutinin__InfluenzaA__AIM56028

SEQ ID NO: 43200 - RNA, 1701 nt, Artificial Sequence
  hemagglutinin__InfluenzaA__AIM56039
augaaggcaauacuaguaguucugcuauauccauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguagaagcaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaacgagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43201 - RNA, 1701 nt, Artificial Sequence
  hemagglutinin__InfluenzaA__AIM56050
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguaucaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcaaaggaaauuggaaacggcugcuuugaauuuuaccacaaaugcgauaacacgugcauggaaagugucaaaaaugggacuuaugacuacccaaaauacucagaggaagcaaaauuaaacagaggaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43202 - RNA, 1701 nt, Artificial Sequence; identical to SEQ ID NO: 41518
  hemagglutinin__InfluenzaA__AIM56061

SEQ ID NO: 43203 - RNA, 1701 nt, Artificial Sequence; identical to SEQ ID NO: 42405
  hemagglutinin__InfluenzaA__AIM56072

SEQ ID NO: 43204 - RNA, 1701 nt, Artificial Sequence; identical to SEQ ID NO: 42397
  hemagglutinin__InfluenzaA__AIM56083

SEQ ID NO: 43205 - RNA, 1701 nt, Artificial Sequence; identical to SEQ ID NO: 41526
  hemagglutinin__InfluenzaA__AIM56105

SEQ ID NO: 43206 - RNA, 1701 nt, Artificial Sequence
  hemagglutinin__InfluenzaA__AIM56116
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuucguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaagguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43207 - RNA, 1701 nt, Artificial Sequence
  hemagglutinin__InfluenzaA__AIM56127
augaaggcaauacuaguaguucugcuauauacauuugcaaccgcaaaugcagacacuuuauguauagguuaucaugcgaacaauucaacagacacuguagacacaguacuagaaaagaauguaacaguaacacacucuguuaaccuucuagaagacaagcauaacgguaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaaggcaaguucauggcccaaucaugacucgaacaaagguguaacggcagcauguccucacgcuggagcaaaaagcuucuacaaaaauuuaauauggcuaguuaaaaaaggaaauucauacccaaagcucagucaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggcaacaggauugaggaauaucccgucuauucaaucuagaggccuauucggggccauugccggcuucauugaagggggguggacagggaugguagauggaugguacgguuaucaccaucaaaaugagcaggggucaggauaugcagccgaccugaaaagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43208 - RNA, 1701 nt, Artificial Sequence
  hemagglutinin__InfluenzaA__AIM56138
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccaugauucaaaugugaaaaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43209 - RNA, 1701 nt, Artificial Sequence
  hemagglutinin__InfluenzaA__AIM56149
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagacuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43210 - RNA, 1701 nt, Artificial Sequence
  hemagglutinin__InfluenzaA__AIM56160
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcacaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugccauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaccaaugccaaggaaauuggaaacggcugcuuugaauuuuaccacaaaugcgauaacacgugcauggaaagugucaaaaaugggaccuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43211 - RNA, 1701 nt, Artificial Sequence
  hemagglutinin__InfluenzaA__AIM56171
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaagggaauucauacccaaagcucagccaauccuacauuaaugauaaagggaaagaaguccucgugcuguggggcauucaucacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagauggaguaaaacuggaaucaacaaggauuuaccagauuuuggcgaucuauucaacugucgccaguucauugguacugguagucucccugggggcaaucagcuucuggauguguucuaaugggucucuacaguguagaauauguauuuaa

SEQ ID NO: 43212 - RNA, 1701 nt, Artificial Sequence
  hemagglutinin__InfluenzaA__AIM56182
augaaggcaauacuaguaguucugcuauauacauuugcaaccgcaaaugcagacacuuuauguauagguuaucaugcgaacaauucaacagacacuguagacacaguacuagaaaagaauguaacaguaacacacucuguuaaccuucuagaagacaagcauaacgguaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaaggcaaguucauggcccaaucaugacucgaacaaagguguaacggcagcauguccucacgcuggagcaaaaagcuucuacaaaaauuuaauauggcuaguuaaaaaaggaaauucauacccaaagcucagucaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggcaacaggauugaggaauaucccgucuauucaaucuagaggccuauucggggccauugccggcuucauugaagggggguggacagggaugguagauggaugguacgguuaucaccaucaaaaugagcaggggucaggauaugcagccgaccugaaaagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacaaagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43213 - RNA, 1701 nt, Artificial Sequence
  hemagglutinin__InfluenzaA__AIM56193
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuucguggggacaucaagauacagcaagaaguucaagccggaaauagcaauaagacccaaagugagggaucaagaagggagaaugaacuauuacuggacacuaguagagccgggagacaaaguaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43214 - RNA, 1701 nt, Artificial Sequence; identical to SEQ ID NO: 41526
  hemagglutinin__InfluenzaA__AIM56204

SEQ ID NO: 43215 - RNA, 1701 nt, Artificial Sequence; identical to SEQ ID NO: 41497
  hemagglutinin__InfluenzaA__AIM56215

SEQ ID NO: 43216 - RNA, 1701 nt, Artificial Sequence
  hemagglutinin__InfluenzaA__AIM56226
augaaggcaauacuaguaguucugcuauacacguuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacauguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43217 - RNA, 1701 nt, Artificial Sequence
  hemagglutinin__InfluenzaA__AIM56237
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggaguuaagagagcaauugagcucagugucaucauuugaaagguuugagauauuccccaaaacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacgguugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugccgccaguucauugguacugguagucucccugggggcaaucagcuucuggaugugcucuaaugggucucuacaguguagaauauguauuuaa

SEQ ID NO: 43218 - RNA, 1701 nt, Artificial Sequence
  hemagglutinin__InfluenzaA__AIM56259
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugauuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43219 - RNA, 1701 nt, Artificial Sequence
  hemagglutinin__InfluenzaA__AIM56270
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuguaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaacgagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43220 - RNA, 1701 nt, Artificial Sequence
  hemagglutinin__InfluenzaA__AIM56281
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugagaaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43221 - RNA, 1701 nt, Artificial Sequence
  hemagglutinin__InfluenzaA__AIM56292
augaaggcaauacuaguaguucugcuauauacacuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacggcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaauccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43222 - RNA, 1701 nt, Artificial Sequence
  hemagglutinin__InfluenzaA__AIM56303
augaaggcaauacuaguaguucugcuauauacacuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacacaaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43223 - RNA, 1701 nt, Artificial Sequence
  hemagglutinin__InfluenzaA__AIM56314
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacauccaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaacgagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaauuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43224 - RNA, 1701 nt, Artificial Sequence
  hemagglutinin__InfluenzaA__AIM56325
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuugggcaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuucguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43225 - RNA, 1701 nt, Artificial Sequence
  hemagglutinin__InfluenzaA__AIM56336
augaaggcaauacuaguaguucugcuauauacauuugcaaccgcaaaugcagacacuuuauguauagguuaucaugcgaacaauucaacagacacuguagacacaguacuagaaaagaauguaacaguaacacacucuguuaaccuucuagaagacaagcauaacgguaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagucaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggcaacaggauugaggaauaucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagauaagaaaccaguuaaaaaacaaugccaaggaaauuggaaacggcugcuuugaauuuuaccacaaaugcgauaacaugugcauggaaagugucaaaaaugggacuuaugacuacccaaaauacucagaggaagcaaaauuaaacagagaaaaaauagaugggguaaagcuggaaucaacaaggauuuaccagauuuuggcgaucuacucaacugucgccaguucauugguacugguagucucccugggggcaaucagcuucuggaugugcucuaaugggucucuacaauguagaauauguauuuaa

SEQ ID NO: 43226 - RNA, 1701 nt, Artificial Sequence
  hemagglutinin__InfluenzaA__AIM56347
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacaacaaguucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccagaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43227 - RNA, 1701 nt, Artificial Sequence
  hemagglutinin__InfluenzaA__AIM56358
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguaaagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugauuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43228 - RNA, 1701 nt, Artificial Sequence; identical to SEQ ID NO: 42902
  hemagglutinin__InfluenzaA__AIM56369

SEQ ID NO: 43229 - RNA, 1701 nt, Artificial Sequence
  hemagglutinin__InfluenzaA__AIM56380
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugaaauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaagcagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43230 - RNA, 1701 nt, Artificial Sequence; identical to SEQ ID NO: 42405
  hemagglutinin__InfluenzaA__AIM56391

SEQ ID NO: 43231 - RNA, 1701 nt, Artificial Sequence; identical to SEQ ID NO: 43206
  hemagglutinin__InfluenzaA__AIM56402

SEQ ID NO: 43232 - RNA, 1701 nt, Artificial Sequence
  hemagglutinin__InfluenzaA__AIM56413
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuauauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguugauggaugguaugguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaccaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43233 - RNA, 1701 nt, Artificial Sequence; identical to SEQ ID NO: 43206
  hemagglutinin__InfluenzaA__AIM56425

SEQ ID NO: 43234 - RNA, 1701 nt, Artificial Sequence
  hemagglutinin__InfluenzaA__AIM56436
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccagaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggguaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacguguauggaaagugucaaaaaugggacuuaugacuacccaaaauacucagaggaagcaaaauuaaacagagaaaaaauagaugggguaaaacuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43235 - RNA, 1701 nt, Artificial Sequence
  hemagglutinin__InfluenzaA__AIM56447
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaaacauaacgggaaacuaugcaagcuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaaaacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43236 - RNA, 1701 nt, Artificial Sequence
  hemagglutinin__InfluenzaA__AIM56469
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccuagugcuguggggcauucaccauccaucuacuacugcugaccaacaaagucucuaucagaaugcagaugcauauguuuucguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43237 - RNA, 1701 nt, Artificial Sequence
  hemagglutinin__InfluenzaA__AIM56480
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguaucaucauuucagauacaccaguccacgauugcaauacaacuugucagacacccgagggugcuauaaacaccagccucccauuucagaauauacauccgaucacacuuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcaaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43238 - RNA, 1701 nt, Artificial Sequence; identical to SEQ ID NO: 43218
  hemagglutinin__InfluenzaA__AIM56491

SEQ ID NO: 43239 - RNA, 1710 nt, Artificial Sequence
  hemagglutinin__InfluenzaA__AIM56502
augaaggcaauacuaguaguucugcuauauacauuugcaaccgcaaaugcagacacuuuauguauagguuaucaugcgaacaauucaacagacacuguagacacaguacuagaaaagaauguaacaguaacacacucuguuaaccuucuagaagacaagcauaacgguaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaaggcaaguucauggcccaaucaugacucgaacaaagguguaacggcagcauguccucacgcuggagcaaaaagcuucuacaaaaauuuaauauggcuaguuaaaaaaggaaauucauacccaaagcucagucaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucaccagccucccauuucagaauauacauccgaucacaauuggaaaauguccaaaguauguaaaaagcacaaaauugagacuggcaacaggauugaggaauaucccgucuauucaaucuagaggccuauucggggccauugccggcuucauugaagggggguggacagggaugguagauggaugguacgguuaucaccaucaaaaugagcaggggucaggauaugcagccgaccugaaaagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43240 - RNA, 1701 nt, Artificial Sequence; identical to SEQ ID NO: 43206
  hemagglutinin__InfluenzaA__AIM56513

SEQ ID NO: 43241 - RNA, 1701 nt, Artificial Sequence
  hemagglutinin__InfluenzaA__AIM56524
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaaacauaacgggaaacuaugcaaacuaagagggguggccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaauccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauacgcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccaugauucaaaugugaagaacuuguaugaaaagguaagaaaccaguuaaaaaacaaugccaaggaaauuggaaacggcugcuuugaauuuuaccacaaaugcgaugacacgugcauggaaagugucaaaaaugggacuuaugacuacccaaaauacucagaagaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43242 - RNA, 1701 nt, Artificial Sequence; identical to SEQ ID NO: 41526
  hemagglutinin__InfluenzaA__AIM56535

SEQ ID NO: 43243 - RNA, 1701 nt, Artificial Sequence; identical to SEQ ID NO: 42405
  hemagglutinin__InfluenzaA__AIM56546

SEQ ID NO: 43244 - RNA, 1701 nt, Artificial Sequence
  hemagglutinin__InfluenzaA__AIM56557
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcacaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugccauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaccaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43245 - RNA, 1701 nt, Artificial Sequence
  hemagglutinin__InfluenzaA__AIM56568
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauucuccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43246 - RNA, 1701 nt, Artificial Sequence
  hemagglutinin__InfluenzaA__AIM56579
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacgagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaauacagaugcauauguuuuuguggggacaucaagauacagcaagaaguucaagccggaaauagcaauaagacccaaagugagggaucaagaagggagaaugagcuauuacuggacacuaguagagccgggagacaaaauaacauucgaagcaacuggaaaucuagugguaccgagauaugcauucacaauggaaagaaaugcuggaucugguauuaucauuucagacacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugcaaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43247 - RNA, 1710 nt, Artificial Sequence
  hemagglutinin__InfluenzaA__AIM56590
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguggccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauacgcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaagaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgaugacacgugcauggaaagugucaaaaaugggacuuaugacuacccaaaauacucagaagaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43248 - RNA, 1710 nt, Artificial Sequence
  hemagglutinin__InfluenzaA__AIM56601
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuucguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucaccagccucccauuucagaauauacauccgaucacaauuggaaaauguccaaaguauguaaaaagcacaaaauugagacuggccacaggguugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43249 - RNA, 1710 nt, Artificial Sequence
  hemagglutinin__InfluenzaA__AIM56612
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuucguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaauacuggaucugguauuaucauuucagauacaccaguccacgauugcaauacaacuugucagacacccgagggugcuauaaacaccagccucaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43250 - RNA, 1701 nt, Artificial Sequence
  hemagglutinin__InfluenzaA__AIM56623
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaacauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuucguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43251 - RNA, 1701 nt, Artificial Sequence
  hemagglutinin__InfluenzaA__AIM56634
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaauucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaggcaaaauuaaacagagaaaaaauagaugggguaaaacuggaaucaacaaggauuuaccagauuuuggcgaucuauucaacugucgccaguucguugguacugguagucucccugggggcaaucagcuucuggaugugcucuaaugggucucuacaguguagaauauguauuuaa

SEQ ID NO: 43252 - RNA, 1710 nt, Artificial Sequence
  hemagglutinin__InfluenzaA__AIM56645
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccagaagagcacacaaaaugccauugacaagauuacuaacaaaguaaacucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43253 - RNA, 1701 nt, Artificial Sequence
  hemagglutinin__InfluenzaA__AIM56656
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaauucauggcccaaucaugacucgaacaaagguguaacagcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccacccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacauuaguagagccgggagacaaaauaacauucgaagcaacuggaaauauagugguaccgagauaugcauucacaauggaaagaaaugcuggaucugguauuaucauuucagauacaccaguccacgauugcaauacaacuugccagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaaggaggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43254 - RNA, 1701 nt, Artificial Sequence
  hemagglutinin__InfluenzaA__AIM56667
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuucguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuggugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43255 - RNA, 1701 nt, Artificial Sequence
  hemagglutinin__InfluenzaA__AIM56678
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguacccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucuggcauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43256 - RNA, 1701 nt, Artificial Sequence; identical to SEQ ID NO: 42892
  hemagglutinin__InfluenzaA__AIM56689

SEQ ID NO: 43257 - RNA, 1701 nt, Artificial Sequence
  hemagglutinin__InfluenzaA__AIM56700
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaaucuuacauuaaugauaaagggaaagaaguccucgugcuguggggcauucaccauccaucuacuacugcugaccaacaaagucucuaucagaaugcagaugcauauguuuucguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaagguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43258 - RNA, 1710 nt, Artificial Sequence
  hemagglutinin__InfluenzaA__AIM56711
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguacccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucuggcauuaucauuucagauacaccaguccacgauugcaauacaacuugucagacacccgagggugcuauaaacaccagccucaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43259 - RNA, 1701 nt, Artificial Sequence; identical to SEQ ID NO: 42892
  hemagglutinin__InfluenzaA__AIM56722

SEQ ID NO: 43260 - RNA, 1701 nt, Artificial Sequence; identical to SEQ ID NO: 43257
  hemagglutinin__InfluenzaA__AIM56733

SEQ ID NO: 43261 - RNA, 1701 nt, Artificial Sequence
  hemagglutinin__InfluenzaA__AIM56744
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuucguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgacaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgcaaguucauugguacugguagucucccugggggcaaucagcuucuggaugugcucuaaugggucucuacaguguagaauauguauuuaa

SEQ ID NO: 43262 - RNA, 1701 nt, Artificial Sequence
  hemagglutinin__InfluenzaA__AIM56755
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccagucaugacucgaacaaaggugugacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuucguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuga

SEQ ID NO: 43263 - RNA, 1710 nt, Artificial Sequence
  hemagglutinin__InfluenzaA__AIM56766
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagauuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccagcaaagucucuaucagaaugcagaugcauauguuuucguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucaccagccucccauuucagaauauacauccgaucacaauuggaaaauguccaaaguauguaaaaagcacaaaauugagacuggccacaggauugaggaaugucccaucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggaaaaaagaauagagaauuuaaauaaaaagguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43264 - RNA, 1701 nt, Artificial Sequence
  hemagglutinin__InfluenzaA__AIM56777
augaaggcaauacuaguaguucugcuauauacauuugcaaccgcaaaugcagacacauuauguauagguuaucaugcgaacaauucaacagauacuguagacacaguacuagaaaagaauguaacaguaacacacucuguuaaccuucuagaaggcaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacauguuacccaggagauuucaucaauuaugaggagcuaagagagcaauugagcucagugucaucauuugaaagguuugagauauuccccaagacgaguucauggcccaaucaugacucgaacaaagguguaacggcagcauguccucacgcuggagcaaaaagcuucuacaaaaauuuaauauggcuaguuaaaaagggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgaaggugcuauaaacaccagccucccauaucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccaugauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43265 - RNA, 1701 nt, Artificial Sequence; identical to SEQ ID NO: 41524
  hemagglutinin__InfluenzaA__AIM56788

SEQ ID NO: 43266 - RNA, 1701 nt, Artificial Sequence; identical to SEQ ID NO: 42405
  hemagglutinin__InfluenzaA__AIM56799

SEQ ID NO: 43267 - RNA, 1701 nt, Artificial Sequence; identical to SEQ ID NO: 42405
  hemagglutinin__InfluenzaA__AIM56810

SEQ ID NO: 43268 - RNA, 1701 nt, Artificial Sequence; identical to SEQ ID NO: 41494
  hemagglutinin__InfluenzaA__AIM56821

SEQ ID NO: 43269 - RNA, 1683 nt, Artificial Sequence
  hemagglutinin__InfluenzaA__AIN76383
augaacacucaaauccugguauucgcucugauugcgaucguuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaagacaguugaccuuggucaauguggacuacuggggacaaucacuggaccaccucaaugugaccaauuccuagaauuuucagccgauuuaauuauugagaggcgagaaggaagugaugucuguuauccuggaaaauucgugaaugaagaagcucugaggcaaauucucagagaaucaggcggaauugacaaggaagcaaugggauucacauacaguggaauaagaacuaauggaacaaccagugcauguaggagaucaggaucuucauucuaugcagaaaugaaauggcuccugucaaacacagauaaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaauggucuaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaagagucugcugcuagcaacagggaugaagaauguuccugagauuccaaagggaagaggccuauuuggugcuauagcagguuucauugaaaauggaugggaaggccuaauugaugguugguaugguuucagacaccagaaugcacagggagagggaacugcugcagauuacaaaagcacucaaucggcaauugaucaaauaacagggaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaguacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaa

SEQ ID NO: 43270 - RNA, 1689 nt, Artificial Sequence
  hemagglutinin__InfluenzaA__AIP93103
auggccaucauuuaucucauacuccuguucacagcagugaggggggaccagauaugcauuggauaccaugccaauaauuccacagaaaaggucgacacaauucuagagcggaaugucacugugacucaugccaaggacauccuugagaagacccauaacggaaagcuaugcaaacuaaacggaauuccuccacuugaacuaggggauuguagcauugccggauggcuccuuggaaauccagaaugugauaggcuucuaagggugccagaaugguccuauauaauggagaaagaaaacccgagauacaguuuguguuauccaggcagcuucaaugacuaugaagaauugaaacaucuccucaguagcguaaaacacuucgagaaaguaaagauucugccaaaagauggauggacacagcaugagacagauggagguucaaaggccugcgcagugucagguaaaccaucauucuucaggaacauggucuggcugacaaagaaaggaccuaauuauccgguugccaaaagaucguacaacaauacgagcggagagcaaaugcuaauaauuuggggagugcaccauccuaaugaugaggcagaacaaagagcauuguaccagaacgugggaaccuauguuuccgcaagcacaucaacauugaacaaaaggucaaccccagaaauagcagcaaggccuaaagugaguggacuaggaaguagaauggaauucucuuggacccucuuggaugugugggacaccauaaguuuugagagcacugguaaucuaguugcaccagaguauggauucaaaauaucgaaaagagguaguucagggaucaugaagacagaaggaacacuugggaacugugagaccaaaugccaaacuccuuugggagcaauaaauacaacacuaccuuuucacaauguccauccacugacaauaggugaaugccccaaauauguaaaaucggagaaauuggucuuagcaacaggaccaaggaauguuccccagauugaaucaagaggauuguuuggggcaauagcuggcuuuauagaaggaggauggcaaggaaugguugauggcugguauggauaccaucacagcaaugaccagggaucaggguaugcagcagacaaagaauccacucaaaaggcauuugacagaaucaccaacaagguaaauucugugauugaaaagaugaacacccaauuugaagcuguugggaaagaauucaguaacuuagagaaaagacuggaaaacuugaacaaaaagauggaagauggguuucuagauguguggacauacaaugcugagcuucuaguucugauggaaaaugagaggacacuugacuuucaugauucuaaugucaagaaccuguaugauaaagucagaaugcagcugagagacaacgucaaagaacuaggaaauggauguuuugaauuuuaucauaaaugugacgaugaaugcaugaauagugugaaaaaugggacguaugauuaucccaaguaugaagaagaaucuaaacuaaagagaaaugaaaucaaaggggugaaauugagcagcauggggguuuaccaaauucuugccauuuaugcuacaguugcagguucucugucacuggcaaucaugauagcugggaucucuuucuggaugugcuccaacgggucucugcagugcagaaucugcauauga

SEQ ID NO: 43271 - RNA, 1689 nt, Artificial Sequence
  hemagglutinin__InfluenzaA__AIP93115
auggccaucauuuaucucauucuccuguucacagcagugagaggggaccagauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacaaagaaaggaucaaauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccagaaauagcaacaaggccuaaagugaauggacuaggagguagaauggaauucucuuggacccucuuggauaugugggacaccauaaauuuugagaguacugguaaucuaauugcaccagaguauggauucaaaauaucgaaaagagguaguucagggaucaugaaaacagaaggaacacuugagaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcaucuga

SEQ ID NO: 43272 - RNA, 1701 nt, Artificial Sequence
  hemagglutinin__InfluenzaA__AIR93971
augaaggcaauacuaguaguucugcuauauacauuugcaaccacaaaugcagacauauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaagaagcuucuacaaaaauuuaauauggcuaguuaaaaagggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccagaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucacuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauguuccgucuauucaaucuaggggccuauuuggggccauugccgguuucauugaagggggguggacagggaugguagauggaugguacgguuaucaccaucaaaaugagcaggggucaggguaugcagccgaccugaagagcacacagaaugccauugacgagauuacuaacaaaguaaauucuguuauugaaaagaugaauacacaguucacagcaguagguaaagaguucaaccaccuggagaaaagaauagagaauuuaaauaaaaagguugaugaugguuuccuggacauuuggacuuacaaugccgaacuguugguucuguuagaaaaugaaagaacuuuggacuaccacgauucaaaugugaagaacuuauaugaaaaggugagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43273 - RNA, 1701 nt, Artificial Sequence
  hemagglutinin__InfluenzaA__AIR93982
augaaggcaauacuaguaguucugcuauacacaauugcaaccgcaaaugcagacacauuauguauagguuaucaugcgaacaauucaacagacacuguagacacgguacuagaaaagaauguaacaguaacacacucuguuaaccuucuagaagacaagcauaaugggaaacuaugcaaacuaagagggguagccccauugcauuuggguaaauguaacauugcuggcuggauccuaggaaauccagagugugaaucacucuccacagcaagcucaugguccuacauuguggaaacaucuaguucagacaauggaacguguuacccaggagauuucaucgauuaugaagagcuaagagagcaauugagcucagugucaucauuugaaagguuugagauauuccccaagacaaguucauggcccaaucaugacucgaacaaagguguaacggcagcauguccucaugcuggagcaagaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaucuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaauuaaaaaccaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43274 - RNA, 1701 nt, Artificial Sequence
  hemagglutinin__InfluenzaA__AIR93993
augaaggcaauacuaguaguucugcuguauacauuugcaacugcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaaaagggguagccccauugcauuuggguaaauguaacauugcuggcuggauccugggaaauccagaguguggaucacucuccacagcaagcucaugguccuacauuguggaaacaucuaguucagacaauggaacguguuacccaggagauuucaucgauuaugaggagcuaagagagcaauugaguucagugucaucauuugaaagguuugagauauuccccaagacaaguucauggcccaaucaugacucgaacaaagguguaacggcagcaugcccuaaugcuggaucaaaaagcuucuacaaaaauuuaauauggcuaguuaaaaaaggaaauucauacccaaagcucagcaaauccuacaucaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaaggaagaauggauuauuacuggacacuaguagagccgggagauaaaauaacauucgaagcaacuggaaaucuagugguaccaagauaugcauucgcaauggaaagaaauacuggaucugguauuaucauuucagauacaccaguccacgauugcaacacaauuugucaaacacccaagggagcuauaaauaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggaggguggacaggaaugguagauggaugguacgguuaucaccaucaaaaugagcaagggucaggauaugcagccgaccugaagagcacacagaaugccauugacgagauuacuaacaaaguaaauucgguuauugaaaagaugaauacacaguucacagcaguagguaaagaguucaaccaucuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagucaauuaaaaaacaaugccaaggaaauuggaaaaggcugcuuugaauuuuaccacaaaugcgauaccaugugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgcuaguucauugguacugguagucucccugggggcaaucaguuucuggaugugcucuaaugggucucuacaguguagaauauguauuuaa

SEQ ID NO: 43275 - RNA, 1701 nt, Artificial Sequence
  hemagglutinin__InfluenzaA__AIR94000
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagcuucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugcuauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaccaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43276 - RNA, 1683 nt, Artificial Sequence
  hemagglutinin__InfluenzaA__AIR94116
auggagacagcaucacugauaacuauacuacuaguaguaacaguaagcaaugcagauaagaucugcaucggcuaucaaucaacaaacuccacagaaacuguagacacacuaacagaaaacaaugucccugugacacaugccaaagaacugcuccacacagagcauaaugggaugcugugugcaacaagcuugggacacccucuuauucuagacaccuguaccauugaaggauuaaucuauggcaauccuucuugugaucuauuguugggaggaagagaaugguccuauauugucgagagaccaucagcuguuaacggauuguguuaucccgggaauguagaaaaucuagaagagcuaagaucacuuuuuaguucugcuaggucuuaucaaaggauccagauuuucccagacacaaucuggaaugugucuuacagugggacaagcaaagcauguucagauucauucuacagaagcaugagaugguugacucaaaaggacaacgcuuacccuauucaagacgcccaauacacaaauaaucaaggaaagaacauucuuuucauguggggcauaaaucacccacccacugauacugcgcagacaaaucuguacacaagaacugacacaacaacgaguguggcaacagaagagauaaauaggacuuucaaaccauugauaggaccaaggccucuugucaacgguuugaugggaagaauuaauuauuauuggucgguauuaaaaccggggcaaacacugcgaauaaaaucuaaugggaauuuaauagcuccaugguaugggcacauucuuucaggagagagccauggaagaauccugaagacugauuuaaaaagggguagcugcacagugcaaugucagacagagaaggguggcuuaaacacaacauugccauuccaaaaugugaguaaguaugcauuuggaaacugcucaaaauacauuggcauaaagagucucaaacuugcaguuggucugaggaaugugccuucuagaucuaguagaggacuauucggggccauagcaggauuuauagagggagguuggucaggacuaguugcugguugguauggauuccagcauucaaaugaccaagggguugguauggcagcagauagagacucaacccaaaaggcaauugauaaaauaacauccaaagugaauaacauagucgacaaaaugaacaagcaguaugaaauuauagaucaugaauucaaugagguugaaacuagacuuaacaugaucaauaauaagauugaugaucaaauccaagauauaugggcauauaaugcagaauugcuaguucugcuugagaaccagaaaacacucgaugagcaugaugcaaacguaaacaaucuauauaauaaagugaagagggcauuggguuccaaugcgguggaagaugggaaaggauguuucgagcuauaccacaaaugugaugaccaaugcauggagacaauucggaacgggaccuacaauagaaggaaauaucaagaggagucaaaauuagaaagacagaagauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 43277 - RNA, 1701 nt, Artificial Sequence
  hemagglutinin__InfluenzaA__AIT38333
augaagacuaucauuacuuugagcuacauuuuaugccauguuuucgcucaaaaaauccacggaagugacagcagcacggcaacauugugccugggacaccaugcagugccaaacggaacgcuagugaaaacaaucacaaaugaccaaauugaagugacuaaugccacugagcugguucagaguuccucaacagguagaauaugcgacaauccucaccgaauccuugaugggaaaaacugcacauugauagaugcucuauuaggagacccucauugcgacgaauuccaaaauaaggaaugggaccuuuuuguugaacgcagcaaugcuuacagcgacuguuacccuuauuaugugccggauuaugccucucuuaggucacuaguugccucauccggcacguuggaguuuaacaaugaaagcuucaauuggacuggaaucucucaggauggaacaagcucuuccugcagaaggggaucuguuaaaaguuucuuuaguagauugaauugguugcacggguuagaauacaaauacccagcacaaaaugugacuaugcuaaacaaugacgaauuugacaaauuguauauuugggggguucaccauccgaguacggacagugaccaaaccagccuauauguucaaacaucagggagagucacagucucuaccaaaagaagccaacaaacuguaaucccgaauaucggaucuagacccuggguaagggguaucuccagcagaauaagcauccauuggacaauaguaaaaccuggagauauacuuuugauuaacagcacagggaaucuaauugccccuagggguuacuuuaaaauacgaggugggaaaagcucaauaaugaggucagaugcacccauugacaacugcgauucugaaugcgucacuccaaaugggaauauucccaaugacaaaccauuucaaaaugugaacaggaucacauaugggcccugucccagauauauuaagcaaaacacccugaaauuggcaacagggaugcggaauguaccagagaaacaaacuagaggcguauugggcgcuaucgcagguuucauagaaaaugguugggagggaaugguagaugguugguacgguuucaggcaucagaauucagagggcacaggacaagcagcagaucuuaaaagcacucaagcagcaaucgaccaaaucaaugggaaacugaauagguuaaucgggaaaacgaacgagaaguuccaucaaauagaaaaagaauucucagagauagaagggagaguucaggaccucgagaaguauguugaagacacuaaaauagaucucuggucguacaacgcagagcuucuuguuguccuggagaaccaacauacaauugaucuaacugacucagaaaugaacaaacuguuugaaagaacaaggaggcaacugagggaaaaugcugaagacaugggcaaugguugcuucaaaauauaccacaaaugugacaaugccugcauagggucaaucagaaauggaacuuauguacaugauguauacagagacgaagcauuaaacaaccgguuccagaucaaagguguugagcuuaagucaggauacaaagauuggauccuauggauuuccuuugccauaucauguuuuuugcuuugugcuguuuugcugggguucaucacgugggccugccaaaaaggcaacauuaggugcaacauuugcauuuaa

SEQ ID NO: 43278 - RNA, 1698 nt, Artificial Sequence
  hemagglutinin__InfluenzaA__AIT38344
augaaaauaaaacuacuaauccuguuauguacauuuacagcuacauaugcagacacaauauguauaggcuaccaugccaacaacucaaccgacacuguugacacagugcuugagaagaaugugacagugacacacucugucaaccuacuugaagacagccacaauggaaaacuaugucuacuaagaggaauagccccccuacaauuggguaauugcagcguugccggauggaucuuaggaaacccagaaugcgaaucacugauuuccaaggaaucaugguccuacauuguagaaaaaccaaauccugaaaaugggacauguuacccaggguauuucgccgacuaugaggagcuaagggagcaauugaguucaguaucuucauuugagagguucgaaauauuccccaaagagaguucauggcccaaccacaccguaaccggaguaucagcaucaugcuccuauaaugggaaaggaaauuuuuacaaaaauuugcuauggcugacgaggaagaauggguuguacccaaaccugagcaagucauauacaaacaacaaagagaaagaaguccuuauacuaugggguguucaucacccgucaaacauaaaggaccaaaggacucucuaucauacagaaaaugcuuaugucucuguagugucuucacauuauagcagaagauucaccccagaaauaaccaaaaggcccaaaguaagagaucaggaaggaagaaucaacuacuacuggacucugcuggaacccggugauacaauaauauuugaggcaaacggaaaucuaauagcgccaugguaugcuuucgcauugaguagaggcuuuggaucaggaaucaucaccucaaaugcaccaauggaugaaugugaagcaaaaugucaaacaccucggggagcuauaaacagcagucuuccuuuccagaauguacacccagucacaauaggagaguguccaaaguaugucaggagugcaaaauuaaggaugguuacaggacuaaggaacaucccuuccauccaauccagagguuuguuuggagccauugccgguuucauugaaggggguuggacuggaaugauagauggaugguaugguuaccaccaucagaaugagcaaggaucugguuaugcugcagauaaagaaagcacacaaaacgccauuaacgggauuacaaacaaggugaauucuguaauugagaaaaugaacacucaauucacaacugugggcaaagaauucaacaaauuggaaagaaggauggaaaacuuaaacaaaaaaguugaugauggguuucuagacauuuggacauauaaugcagaauuguugguucuacuggaaaaugaaaggacuuuagauuuccacgacucuaauguaaaaauucuguaugagaaaguaaagagccaauuaaagaauaaugccaaagaaauuggaaauggguguuuugaauucuaccacaaguguaacaaugaaugcauggagagugugaaaaauggaacuuaugacuacccaaaauauucugaagaaucaaaguuaaacagggaaaaaaucgauggaguaaaauuggaaucaaugggagucuaucagauucuggcgaucuauucaacugucgccaguucccugguucuuuuggucucccugggggcaaucagcuucuggauguguuccaaugggucuuugcaguguagaauaugcaucuga

SEQ ID NO: 43279 - RNA, 1698 nt, Artificial Sequence
  hemagglutinin__InfluenzaA__AIT38360
augaaaauaaaacuacuaauccuguuauguacauuuacagcuacauaugcagacacaauauguauaggcuaccaugccaacaacucaaccgacacuguugacacagugcuugagaagaaugugacagugacacacucugucaaccuacuugaagacagucacaauggaaaacuaugucuacuaaaaggaauagccccccuacaauuggguaauugcagcguugccggauggaucuuaggaaacccagaaugcgaaucacugauuuccaaggaaucaugguccuacauuguagaaaaaccaaauccugaaaaugggacauguuacccaggauauuucgccgauuaugaggagcuaagggagcaauugaguucaguaucuucauuugagagguucgaaauauuccccaaagagagcucauggcccaaccacaccguaaccggaguaucagcaucaugcuccuauaaugggaaaggaaauuuuuacaaaaauuugcuauggcugacgaggaagaauggguuguacccaaaccugagcaagucauauacaaacaacaaagagaaagaaguccuuauacuaugggguguucaucacccgucaaacauagaggaccaaaggacucucuaucauacagaaaaugcuuaugucucuguagugucuucacauuauagcagaagauucaccccagaaauaaccaaaaggcccaaaguaagaggucaggaaggaagaaucaacuacuacuggacucugcuggaacccggugauacaauaauauuugaggcaaacggaaaucuaauagcgccaugguaugcuuucgcauugaguagaggcuuaggaucaggaaucaucaccucaaaugcaccaauggaugaaugugaagcaaaaugucaaacaccucggggagcuauaaacagcagucuuccuuuccagaauguacacccagucacaauaggagaguguccaaaguaugucaggagugcaaaauuaaggaugguuacaggacuaaggaacauccccucuauccaauccagagguuuguuuggagccauugccgguuucauugaaggggguuggacuggaaugauagauggaugguaugguuaccaccaucagaaugagcaaggaucugguuaugcugcagauaaagaaagcacacaaaacgccauuaacgggauuacaaacaaggugaauucuguaauugagaaaaugaacacucaauucacaacugugggcaaagaauucaacaaauuggaaagaaggauggaaaacuuaaacaaaaaaguugaugauggguuucuagacauuuggacauauaaugcagaauuguugguucuacuggaaaaugaaaggacuuuagauuuccacgacucuaauguaaaaaaucuguaugagaaaguaaagagccaauuaaagaauaaugccaaagaaauuggaaauggguguuuugaauucuaccacaaguguaacaaugaaugcauggagagugugaaaaauggaacuuaugacuacccaaaauauucugaagaaucaaaguuaaacagggaaaaaaucgauggaguaaaauuggaaucaaugggagucuaucagauucuggcgaucuauucaacugucgccaguucccugguucuuuuggucucccugggggcaaucagcuucuggauguguuccaaugggucuuugcaguguagaauaugcaucuga

SEQ ID NO: 43280 - RNA, 1701 nt, Artificial Sequence
  hemagglutinin__InfluenzaA__AIT93147
augaaggcaauacuaguaguucugcuauauacauuugcaaccgcaaaugcagacacauuauguauagguuaucaugcgaacaauucaacagauacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacauguuacccaggagauuucaucaauuaugaggagcuaagagagcaauugagcucagugucaucauuugaaagguuugagauauuccccaagacgaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgaaggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaaguguuaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 43281 - RNA, 1701 nt, Artificial Sequence
  hemagglutinin__InfluenzaA__AIU39700
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuuuauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43282 - RNA, 1701 nt, Artificial Sequence
  hemagglutinin__InfluenzaA__AIU39702
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagcuucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43283 - RNA, 1701 nt, Artificial Sequence
  hemagglutinin__InfluenzaA__AIU39704
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucucuacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaucaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguauugguagucucccugggggcaaucaguuucuggaugugcucuaaugggucucuacaguguagaauauguauuuaa

SEQ ID NO: 43284 - RNA, 1704 nt, Artificial Sequence
  hemagglutinin__InfluenzaA__AIU46609
auggagaaaauagugcuucuucuugcaauagucagccuuguuaaaagugaucagauuugcauugguuaccaugcaaacaacucgacggagcagguugacacgauaauggaaaagaacgucacuguuacacaugcccaagacauacuggaaaagacacacaaugggaagcucugcgauuuaaauggagugaagccucuaauuuuaaaggauuguaguguagcuggauggcuucucggaaacccaaugugcgacgaauucaucagggugccggaauggucuuacauaguagaaagggcuaacccagccaaugaccucuguuacccagggaaccucaaugauuaugaagaacugaaacaccuauugagcagaauaaaucauuuugagaaaauucugaucauccccaagaguucuuggaccaaucaugaaacaucauuaggggugagcgcagcaugcccauaccagggaacgcccuccuuuuucagaaaugugguauggcuuaucaaaaagaacgaugcauaccccacaauaaaaauaagcuacaauaauaccaaucaggaagaucuguugauacugugggggauucaccauuccaacaaugcagcagagcagacgaaccucuauaaaaacccaaccaccuacauuuccguugggacaucaacauuaaaccagagauugguaccaaaaauagcuacuagaucccaagugaauggacagcguggaagaauggauuucuucuggacaauucuaaaaccgaaugaugcaauccauuucgagaguaauggaaauuucauugcuccagaauaugcauacaaaauugucaagaaaggggacucaacaauuaugaaaagugaaguggaauauggccacugcaacaccaaaugucaaacuccaauaggggcgauaaacucuaguaugccauuucacaauauacacccucucaccaucggggaaugccccaaauacgugaaaucaaacaaauuaguccuugcgacugggcucagaaauaguccucuaagagaaaagagaagaaaaagaggacuauuuggagcuauagcaggguuuauagagggaggauggcagggaaugguagauggcugguauggguaccaccauagcaaugagcaggggaguggguacgcugcagacaaagaauccacccaaaaggcuauagauggaguuaccaauaaggucaacucgauuauugacaaaaugaacacucaauuugaggccguuggaagggaauuuaauaacuuagaaaggagaauagagaauuuaaacaagaaaauggaagacggauuccuagaugucuggacuuauaaugcugaacuucuaguucucauggaaaaugagagaacucuagauuuccaugacucaaaugucaagaaccuuuacgauaaaguccgacuacagcuuagggacaaugcaaaggagcuggguaaugguuguuuugaguucuaucacaaaugugauaaugaauguauggaaaguguaagaaaugggacauaugacuacccgcaauauucagaagaagcaagauuaaaaagagaagaaauaagcggagugaaauuagagucaauaggaacuuaccaaauacugucaauuuauucaacaguggcgaguucccuagcacuggcaaucauaguggcugguuuaucuuuauggaugugcuccaaugggucguugcagugcagaauuugcauuuaa

SEQ ID NO: 43285 - RNA, 1689 nt, Artificial Sequence
  hemagglutinin__InfluenzaA__AIU46714
auggccaucauuuaucucauacuccuguucacagcagugaggggggaccagauaugcauuggauaccaugccaauaauuccacagaaaaggucgacacaauucuagagcggaaugucacugugacucaugccaaggacauccuugagaagacccauaacggaaagcuaugcaaacuaaacggaauuccuccacuugaacuaggggauuguagcauugccggauggcuccuuggaaauccagaaugugauaggcuucuaagggugccagaaugguccuauauaauggaaaaagaaaacccgaaauacaguuuguguuauccaggaagcuucaaugacuaugaagaauuaaaacaucuccucaguagcguaaaacacuucgagaaaguaaagauucugccaaaagauggauggacacagcauaagacagauggagguucaaaggccugcgcaguuucagguaaacaaucauucuucaggaacauggucuggcugacaaagaaaggacaaaauuauccgguugccaaaagaucguacaacaauacgagcggagagcaaaugcuaauaauuuggggagugcaccauccuaaugaugaggaggaacaaagagcauuguaccagaaagugggaaccuauguuuccgcaagcacaucaacauugaacaaaaggucaaccccagaaauagcagcaaggccugaagugaauggacuaggaaguagaauggaauucucuuggacccucuuggaugugugggacaccauaaauuuugagagcacugguaaucuaguugcaccagaguauggauucaaaauaucgaaaagagguaguucagggaucauaaagacagaaggaacacuugggaacugugagaccaaaugccaaacuccuuugggagcaauaaauacaacacuaccuuuucacaauguccacccacugacaauaggugaaugccccaaauauguaaaaucggagaaauuggucuuagcaacaggacuaaggaauguuccucagauugaaucaagaggauuguucggggcaauagcuggcuuuauagaaggaggauggcaaggaaugguugaugguugguauggauaccaucacagcaaugaccagggaucaggguaugcagcagacaaagaauccacucaaaaggcauuugacagaaucaccaacaagguaaauucugugauugaaaagaugaacacccaauuugaagcuguugggaaagaauucagcaacuuagagagaagacuggaaaacuugaacaaaaagauggaagacggguuucuagauguguggacauacaaugcugaacuucuaguucugauggaaaaugagaggacacuugacuuucaugauucuaaugucaagaaccuguaugauaaagucagaaugcagcugagagacaacgucaaagaacuaggaaauggauguuuugaauuuuaucauaaaugugacaaugaaugcaugaauagugugaaaaaugggacguaugauuaucccaaguaugaagaagaaucuaaacuaaagagaaaugaaaucaaagggguaaaauugagcagcauggggguuuaccaaauucuugccauuuaugcuacaguugcagguucucugucacuggcaaucaugauagcugggaucucuuucuggaugugcuccaacgggucucugcagugcagaaucugcauauga

SEQ ID NO: 43286 - RNA, 1701 nt, Artificial Sequence
  hemagglutinin__InfluenzaA__AIV09219
augaaggcaauacuaguaguucugcuauauacauuugcaaccacaaaugcagacauauuauguauagguuaucaugcgaacaauucaacagacacuguagacacaguacuggaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaauuacucuccacaacaagcucaugguccuacauuguggaaacaucuaguucagacaauggaacguguuaccccggagauuucaucgauuaugaggagcuaagagagcaauugagcucagugucaucauuugaaagguuugagauauuccccaagacaaguucauggcccgaucaugacucgaacaaagguguaacggcagcaugcccucaugcuggggcaggaagcuucuacaaaaauuuaauauggcuaguuaaaaagggaaauucauacccaaagcucagcaaauccuacauuaaugauaaagggaaagaaguccucgugcuauggggcauucaccauccaccuacuagugcugaccaacaaaggcucuaucagaaugcagaugcauauguuuuuguggggacaucaagauacagcaagaaguucaagccagaaauagcaauaagacccaaagugagggaucaagaagggagaaugaacuauuacuggacacuaguagagccgggggacaaaauaacauucgaagcaacuggaaaucuagugguaccgagauaugcauucgcaauggaaagaaaugcuggaucugguauuaucacuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauguuccgucuauucaaucuaggggccuauuuggggccauugccgguuucauugaagggggguggacagggaugguagauggaugguacgguuaucaccaucaaaaugagcagggaucaggguaugcagccgaccugaagagcacacagaaugccauugacgagauuacuaacaaaguaaauucuguuauugacaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuagaaaaugaaagaaccuuggacuaucacgauucaaaugugaagaacuuauaugaaaaggugagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43287 - RNA, 1701 nt, Artificial Sequence
  hemagglutinin__InfluenzaA__AIW60689
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcgacuguuacccuuaugaugugccggauuaugcuucccuuaggucacuaguugccucauccggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagcauauauguucaagcaucagggagagucacagucucuaccaaaagaagccaacaaacuguaaucccgaauaucgggucuagacccuggguaagggggaucuccagcagaauaagcaucuauuggacaauaguaaaaccgggagacauacuuuugauuaauagcacagggaaucuaauugccccucgggguuacuucaaaauacgaagugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauuaugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcagagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugaugcauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 43288 - RNA, 1701 nt, Artificial Sequence
  hemagglutinin__InfluenzaA__AIW60690
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcgacuguuacccuuaugaugugccggauuaugcuucccuuaggucacuaguugccucauccggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggggucuccagcagaauaagcaucuauuggacaauaguaaaaccgggagacauacuuuugauuaauagcacagggaaucuaauugccccucgggguuacuucaaaauacgaagugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauuaugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcagagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugaugcauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 43289 - RNA, 1701 nt, Artificial Sequence
  hemagglutinin__InfluenzaA__AIW60691
augaagacuaucauugcuuugagcuacauuuuaugucugguuuucgcucaaaaacuucccggaaaugacaacagcacggcaacgcugugccugggacaccaugcagugccaaacggaacgcuagugaaagcaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcgacuguuacccuuaugaugugccggauuaugcuucccuuaggucacuaguugccucauccggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagacuauauguucaagcaucagggagagucacagucucuaccaaaagaagccaacaaacuguaaucccgaauaucgggucuagacccuggguaagggggaucuccagcagaauaagcaucuauuggacaauaguaaaaccgggagacauacuuuugauuaauagcacagggaaucuaauugccccucgggguuacuucaaaauacgaagugggaaaagcucaauaaugaggucagaugcacccauuggcaacugcaauucugaaugcaucacuccaaaugggagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaaugggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcagagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 43290 - RNA, 1701 nt, Artificial Sequence
  hemagglutinin__InfluenzaA__AIW60692
augaagacuaucauugcuuugagcuacauuuuaugucugguuuucgcucaaaaacuucccggaaaugacaacagcacggcaacgcugugccugggacaccaugcagugccaaacggaacgcuagugaaagcaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcgacuguuacccuuaugaugugccggauuaugcuucccuuaggucacuaguugccucauccggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaagggggaucuccagcagaauaagcaucuauuggacaauaguaaaaccgggagacauacuuuugauuaauagcacagggaaucuaauugccccucgggguuacuucaaaauacgaagugggaaaagcucaauaaugaggucagaugcacccauuggcaacugcaauucugaaugcaucacuccaaaugggagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaaugggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcagagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 43291 - RNA, 1701 nt, Artificial Sequence
  hemagglutinin__InfluenzaA__AIW60693
augaagaccaucauugcuuugagcuacauuuuaugucugguuuucgcucaaaaacuucccggaaaugacaacagcacagcaacgcugugccugggacaccaugcagugcuaaacggaacgcuagugaaaacaaucacgaaugaccaaauugaagugacuaaugcuacugagcugguucagaauuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaccagcauauaugcucaagcaucagggagagucacagucucuaccaaaagaagccaacaaacuguaaucccgaauaucggaucuagacccuggguaaggggugucuccagcauaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguggacgguugguacgguuucaggcaucaaaauucugagggcacaggacaagcagcagaucucaaaagcacucaagcagcaaucaaccaaaucaacggaaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 43292 - RNA, 1701 nt, Artificial Sequence
  hemagglutinin__InfluenzaA__AIW60694
augaagacuaucauugcuuugagcuacauuuuaugucugguuuucgcucaaaaacuucccggaaaugacaacagcacagcaacgcugugccugggacaccaugcagugcuaaacggaacgcuagugaaaacaaucacgaaugaccaaauugaagugacuaaugcuacugagcugguucagaauuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguggacgguugguacgguuucaggcaucaaaauucugagggcacaggacaagcagcagaucucaaaagcacucaagcagcaaucaaccaaaucaacggaaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 43293 - RNA, 1701 nt, Artificial Sequence
  hemagglutinin__InfluenzaA__AIW60695
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaacuacaaauacccagcacugaacgugacuaugccaaacaaugaaaaauuugacaaauuguacauuugggggguucaccacccgaguacggacagugaccaaaucagcauauaugcucaagcaccagggagagucacagucucuaccaaaagaagccaacaaacuguaaucccgaauaucggaucuagacccuggguaaggggugucuccagcauaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugauaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 43294 - RNA, 1701 nt, Artificial Sequence
  hemagglutinin__InfluenzaA__AIW60696
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgaucagaauggaacaagcucugcuugcaaaaggagaucuaauaaaaguuucuuuaguagauugaauugguugcaccaauuaaaauacaaauacccagcacugaacguggcuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuagaugcaacauuugcauuuga

SEQ ID NO: 43295 - RNA, 1701 nt, Artificial Sequence
  hemagglutinin__InfluenzaA__AIW60697
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucuucuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggauacggacaguguccaaaucagccuauaugcucaagcaucaggaagaaucacagucucuaccaaaagaagccaacaaacuguaaucccgaauaucggaucuagacccaggguaagggauaucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43296 - RNA, 1701 nt, Artificial Sequence
  hemagglutinin__InfluenzaA__AIW60698
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggauaucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43297 - RNA, 1701 nt, Artificial Sequence
  hemagglutinin__InfluenzaA__AIW60699
augaagacuaucauugcuuugagcuacauucuaugucugguuuucgcucaaaaacuucccggaaaugacaacagcacggcaacgcugugcauugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaagaauuugacaaauuguacauuugggggguucaccacccgguuacggacaaugaccaaaucagccuauaugcucaagcaucaggaaaaaucacagucucuaccaaaagaagccaacaaacuguaaucccgaauaucggaucuagacccaggguaagggauauccccagcagaauaagcaucuauuggacaauaguaaaaccgggagacauacuuuugauuaaaagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuuccggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauccaggaccucgagaaauauguugaggacacuaaaauagaucucuggucauacaacgcggagcuucuuguugcccuggagaaccaacauacaauugaucuaacugacucagaaaugaacaaacuguuugaagaaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43298 - RNA, 1701 nt, Artificial Sequence
  hemagglutinin__InfluenzaA__AIW60700
augaagacuaucauugcuuugagcuacauucuaugucugguuuucgcucaaaaacuucccggaaaugacaacagcacggcaacgcugugcauugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaagaauuugacaaauuguacauuugggggguucaccacccggguacggacaaugaccaaaucagccuauaugcucaagcaucaggaaaaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauccaggaccucgagaaauauguugaggacacuaaaauagaucucuggucauacaacgcggagcuucuuguugcccuggagaaccaacauacaauugaucuaacugacucagaaaugaacaaacuguuugaagaaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43299 - RNA, 1701 nt, Artificial Sequence
  hemagglutinin__InfluenzaA__AIW60701
augaagacuaucauugcuuugagcuacauucuaugucugguuuucacucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuucccguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaacggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43300 - RNA, 1701 nt, Artificial Sequence
  hemagglutinin__InfluenzaA__AIW60702
augaagacuaucauugcuuugagcuacauucuaugucugguuuucacucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccaggguaaggaauauccccagccgaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43301 - RNA, 1701 nt, Artificial Sequence
  hemagglutinin__InfluenzaA__AIZ07211
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcuaaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43302 - RNA, 1701 nt, Artificial Sequence
  hemagglutinin__InfluenzaA__AIZ07212
augaagacuaucauggccuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcuaaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43303 - RNA, 1683 nt, Artificial Sequence
  hemagglutinin__InfluenzaA__AJD78175
auggagacagcaucacugauaacuauacuacuaguaguaacaguaagcaaugcagauaagaucugcaucggcuaccaaucaacaaacuccacagaaacuguagacacacuaacagaaaacaaugucccugugacacaugccaaagaacugcuccacacagagcauaaugggaugcugugugcaacaagcuugggacaaccucuuauucuagacacuuguaccauugaaggauuaaucuauggcaauccuucuugugaucuauuguugggaggaagagaaugguccuauaucgucgagagaccaucagcugcuaacggauuguguuaucccgggaauguagaaaaucuagaagagcuaagaucacuuuuuaguucugcuaggucuuaucaaaggauccagauuuucccagacacaaucuggaaugugucuuacagugggacaagcaaagcauguucagauucauucuacagaagcaugagaugguugacucaaaaggacaacacuuacccuauucaagacgcccaauacacaaauaaucaaggaaagaacauucuuuucauguggggcauaaaucacccacccacugauacugcgcagacaaaucuguacacaagaaccgacacaacaacgaguguggcaacagaagagauaaauaggacuuucaaaccauugauaggaccaaggccucuugucaacgguuugaugggaagaauuaauuauuauuggucgguauuaaaaccgggucaaacacugcgaauaaaaucuaaugggaauuuaauagcuccaugguauggacacauucuuucaggagagagccacggaagaauccugaagacugauuuaaaaagggguagcugcacagugcaaugucagacagagaaggguggcuuaaacacaacauugccauuccaaaaugugaguaaguaugcauuuggaaacugcucaaaauacauuggcauaaagagucucaaacuugcaguuggucugaggaaugugccuucuagaucuaguagaggacuauucggggccauagcaggauuuauagagggagguuggucaggacuaguugcugguugguauggauuccagcauucaaaugaccaagggguugguauggcagcagauagagacucaacccaaaaggcaauugauaaaauaacauccaaagugaauaacauagucgacaaaaugaacaagcaguaugaaauuauagaucaugaauucaaugagguugaaacuagacuuaacaugaucaauaauaagauugaugaucaaauccaagauauaugggcauauaaugcagaauugcuaguucugcuugagaaccagaaaacacucgaugagcaugaugcaaacguaaacaaucuauauaauaaagugaagagggcauuggguuccaaugcgguggaagaugggaaaggauguuucgagcuauaccacaaaugugaugaccaaugcauggagacaauucggaacgggaccuacaauagaaggaaauaucaagaggagucaaaauuagaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 43304 - RNA, 1683 nt, Artificial Sequence
  hemagglutinin__InfluenzaA__AJD78187
auggagacagcaucacugauaacuauacuacuaguaguaacaguaagcaaugcagauaagaucugcaucggcuaucaaucaacaaacuccacagaaacuguagacacacuaacagaaaacaaugucccugugacacaugccaaagaacugcuccacacagagcauaaugggaugcugugugcaacaagcuugggacacccucuuauucuagacaccuguaccauugaaggguuaaucuauggcaauccuucuugugaucuauuguugggaggaagagaaugguccuauaucgucgagagaccaucagcuguuaacggauuguguuaucccgggaauguagaaaaucuagaagaacuaagaucacuuuuuaguucugccaggucuuaucaaaggauccagauuuucccagacacaaucuggaaugugucuuacagugggacaagcaaaacauguucagauucauucuacagaagcaugagaugguugacucaaaaggacaacgcuuacccuauccaagacgcccaauacacaaauaaucaaggaaagaacauucuuuucauguggggcauaaaucacccacccacugauacuacgcagacaaaucuguacacaagaaccgacacgacaacgaguguggcaacagaagagauaaauaggacuuucaaaccauugauaggaccaaggccucuugucaacgguuugaugggaagaauuaauuauuauuggucgguauuaaaaccgggucaaacacugcgaauaaaaucuaaugggaauuugauagcuccaugguauggacacauucuuucaggagagagccacggaagaauccugaagacugauuuaaaaagggguagcugcacaguacaaugucagacagagaaggguggcuuaaacacaacauugccauuccaaaaugugaguaaguaugcauuuggaaacugcucaaaauacauuggcauaaagagucucaaacuugcaguuggucugaggaaugugccuucuagaucuaguagaggacuauucggggccauagcaggauuuauagagggagguuggucaggacuaguugcugguugguauggauuccagcauucaaaugaccaagggguugguauggcagcagauagagacucaacccaaaaggcaauugauaaaauaacauccaaagugaauaacauagucgacaaaaugaacaagcaguaugaaauuauagaucaugaauucagugagguugaaacuagacuuaacaugaucaauaauaagauugaugaucaaauccaagauauaugggcauauaaugcagaauuguuaguucugcuugagaaccagaaaacacucgaugagcaugaugcaaacguaaacaaucuauauaauaaagugaagagggcguuggguuccaaugcgguggaagaugggaaaggauguuucgagcuauaccacaaaugugaugaccaaugcauggagacaauucggaaugggaccuacaauagaaggaaauaucaagaggagucgaaauuagaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 43305 - RNA, 1683 nt, Artificial Sequence
  hemagglutinin__InfluenzaA__AJD78199
auggagacaguaucacuaauaacuauacuacuaguagcaacaguaagcaaugcagauaaaaucugcaucggcuaucaaucaacaaacuccacagaaacuguggacacacuaacagaaaacaaugucccugugacacaugccaaagaacugcuccacacagagcauaaugggaugcugugugcaacaagcuugggacaaccucuuauuuuagacaccugcaccauugaagggcuaaucuauggcaauccuucuugugaucuaucgcuggaaggaagagaaugguccuauaucgucgagagaccaucagcuguuaacggauuguguuaccccgggaauguagaaaaucuagaagagcuaaggucacuuuuuaguucugcuaggucuuaucaaagaauccagauuuucccagacacaaucuggaaugugucuuacgaugggacaagcacagcaugcucagguucauucuacagaagcaugagaugguugacucggaagaacggcgauuacccuauccaagacgcccaauacacaaauaaucaagggaagaacauucuuuucauguggggcauaaaucacccacccaccgauacuacacagagagaucuguacacgagaaccgacacaacaacgaguguggcaacagaagaaauaaauaggaucuucaaaccauugauaggaccaaggccucuugucaacgguuugaugggaagaauugauuauuauuggucuguauugaaaccgggucagacacugcgaauaaaaucugaugggaaucuaauagcuccaugguauggacacauucuuucaggagagagccacggaagaauucugaagacugauuuaaaaagggguagcugcacagugcaaugucagacagagaaagguggcuuaaacacaacacugccauuccaaaauguaaguaaguaugcauuuggaaacugcucaaaauacauuggcauaaagagucucaaacuugcaguuggucugaggaaugugccuucuagaucuaguagaggacuauucggggccauagcaggguuuauagagggagguuggucaggacuaguugcugguugguauggauuccagcauucaaaugaccaagggguugguauggcagcagauagagacucaacccaaaaggcaauugauaaaauaacauccaaagugaauaauauagucgacaaaaugaacaagcaguaugaaaucauugaucaugaauucagugagguagaaacuagacuuaacaugaucaauaauaagauugaugaucaaauccaggauauaugggcauauaaugcagaauugcuaguucugcuugaaaaccagaaaacacucgaugagcaugacgcaaauguaaacaaucuauauaauaaaguaaagagggcguuggguuccaaugcgguggaagaugggaaaggauguuucgagcuauaccacaaaugugaugaccaaugcauggagacaauucggaacgggaccuacaacagaaggaaguaucaagaggagucaaaauuagaaagacagaaaauagagggggucaagcuggaaucugaaggaacuuacaaaauccucaccauuuauucgacuguugccucaucucuugugauugcaaugggguuugcugccuucuuguucugggccauguccaaugggucuugcagaugcaacauuuguauauaa

SEQ ID NO: 43306 - RNA, 1683 nt, Artificial Sequence
  hemagglutinin__InfluenzaA__AJD78211
auggagacaguaucacuaauaacuauacuacuaguagcaacaguaagcaaugcagauaaaaucugcaucggcuaucaaucaacaaacuccacagaaacuguggacacacuaacagaaaacaaugucccugugacacaugccaaagaacugcuccacacagagcauaaugggaugcugugugcaacaagcuugggacaaccucuuauuuuagacaccugcaccauugaagggcuaaucuauggcaauccuucuugugaucuaucgcuggaaggaagagaaugguccuauaucgucgagagaccaucagcuguuaacggauuguguuaccccgggaauguagaaaaucuagaagagcuaaggucacuuuuuaguucugcuaggucuuaucaaagaauccagauuuucccagacacaaucuggaaugugucuuacgaugggacaagcacagcaugcucagguucauucuacagaagcaugagaugguugacucgaaagaauggcgauuacccuauccaagacgcccaauacacaaauaaucaagggaagaacauucuuuucauguggggcauaaaucacccacccaccgauacuacacagagagaucuguacacgagaaccgacacaacaacgaguguggcaacagaagaaauaaauaggaucuucaaaccauugauaggaccaaggccucuugucaacgguuugaugggaagaauugauuauuauuggucuguauugaaaccgggucagacacugcgaauaaaaucugaugggaaucuaauagcuccaugguauggacacauucuuucaggagagagccacggaagaauucugaagacugauuuaaaaagggguagcugcacagugcaaugucagacagagaaagguggcuuaaacacaacacugccauuucaaaauguaaguaaguaugcauuuggaaacugcucaaaauacauuggcauaaagagccucaaacuugcaguuggucugaggaaugugccuucuagaucuagaagaggacuauucggggccauagcaggguuuauagaaggagguuggucaggacuaguugcugguugguauggauuccagcauucaaaugaccaagggguugguauggcagcagauagagacucaacccaaaaggcaauugauaaaauaacauccaaagugaauaauauagucgacaaaaugaacaagcaguaugaaaucauugaucaugaauucagugagguagaaacuagacuuaacaugaucaauaauaagauugaugaucaaauccaggauauaugggcauauaaugcagaauugcuaguucugcuugaaaaccagaaaacacucgaugagcaugacgcaaauguaaacaaucuauauaauaaaguaaagagggcguuggguuccaaugcgguggaagaugggaaaggauguuucgagcuauaccacaaaugugaugaccaaugcauggagacaauucggaacgggaccuacaacagaaggaaguaucaagaggagucaaaauuagaaagacagaaaauagagggggucaagcuggaaucugaaggaacuuacaaaauccucaccauuuauucgacuguugccucaucucuugugauugcaaugggguuugcugccuucuuguucugggccauguccaaugggucuugcagaugcaacauuuguauauaa

SEQ ID NO: 43307 - RNA, 1689 nt, Artificial Sequence
  hemagglutinin__InfluenzaA__AJI76401
auggccaucauuuaucucauacuccuguucgcaacggugagaggggaccagauaugcauuggauaccaugccaauaauuccacagaaaaggucgacacaauucuagagcggaaugucacugugacucaugccaaggacauccuugagaagacccacaacggaaagcuaugcaaacuaaacggaaucccuccacuugaacuaggggacuguagcauugccggauggcuucuuggaaauccagaaugugauaggcuucuaagggugccagaauggucauauauaauggaaaaagaaaacccaagauacaguuuguguuacccaggcagcuuaaaugacuaugaagaauugaaacaucuccucagcagcguaaaacauuucgagaaaguaaggauccugcccaaagauagauggacaaaucauacaacaacuggagguucaaaggccugcgcagugucagguaaaccaucauucuucaggaacauggucuggcugacaaagaaaggaccaaauuauccggucgccaaaggaucguacaacaauacgagcggggagcaaaugcuaauaauuuggggggugcaccauccuauugaugaggcagaacaaagagcauuguaccagaacgugggaaccuauguuuccgcaagcacaucaacauuguacaaaaggucaaucccugaaauagcagcaaggccugaagugaauggacuuggaaguagaauggaauucucuuggacccucuuggauguaugggacaccauaaauuuugagagcacugguaaucuaguugcaccagaguauggauucaaaauaucaaaaagagguaguucagggaucaugaagacagaaggaacacuugggaacugugagaccaaaugccaaacuccuuugggagcaauaaauacaacacuaccuuuucacaauguccacccacugacaauaggugaaugccccaaauauguaaaaucggagaaauuggucuuagcaacaggacuaaggaauguuccccaaauugaaucaagaggauuguuuggggcaauagcuggcuuuauagaaggaggauggcaaggaaugguugaugguugguauggauaccaccacagcaaugaccagggaucaggguaugcagcagacaaagaauccacucaaaaagcauuugauggaaucaccaacaagguaaauucugugauugaaaagaugaacacccaauuugaagcuguugggaaagaauucaauaacuuagagaaaagacuggagaacuugaacaaaaggauggaagacggguuccuagauguguggacauauaaugcugagcuucuaguucugauggaaaaugaaaggacacuugacuuccaugauucuaauguaaaaaaccuguaugaaaaagucagaaugcagcugagagacaacgucagagaacuaggaaauggauguuuugaauuuuaucacaaaugugacgaugaaugcaugaauagugugaaaaacggaacauaugauuaucccaaguaugaagaagaaucuaaacuaaagagaaaugaaaucaaagggguaaaauuaagcagcauggggguuuaccaaauucuugccauuuaugcuacaguugcagguucucugucacuggcaaucaugguagcugggaucucuuucuggaugugcuccaacgggucucugcagugcagaaucugcauauga

SEQ ID NO: 43308 - RNA, 1701 nt, Artificial Sequence; identical to SEQ ID NO: 42569
  hemagglutinin__InfluenzaA__AJI80137

SEQ ID NO: 43309 - RNA, 1701 nt, Artificial Sequence; identical to SEQ ID NO: 42569
  hemagglutinin__InfluenzaA__AJI80149

SEQ ID NO: 43310 - RNA, 1701 nt, Artificial Sequence; identical to SEQ ID NO: 43132
  hemagglutinin__InfluenzaA__AJI80161

SEQ ID NO: 43311 - RNA, 1701 nt, Artificial Sequence
  hemagglutinin__InfluenzaA__AJI80172
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcucacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucaccccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaggcauugaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43312 - RNA, 1701 nt, Artificial Sequence
  hemagglutinin__InfluenzaA__AJI80196
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaaggaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauauaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggaguuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaggcauugaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43313 - RNA, 1701 nt, Artificial Sequence; identical to SEQ ID NO: 43166
  hemagglutinin__InfluenzaA__AJI80208

SEQ ID NO: 43314 - RNA, 1701 nt, Artificial Sequence
  hemagglutinin__InfluenzaA__AJI80220
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucagaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43315 - RNA, 1701 nt, Artificial Sequence; identical to SEQ ID NO: 43311
  hemagglutinin__InfluenzaA__AJI80232

SEQ ID NO: 43316 - RNA, 1701 nt, Artificial Sequence; identical to SEQ ID NO: 43314
  hemagglutinin__InfluenzaA__AJI80244

SEQ ID NO: 43317 - RNA, 1701 nt, Artificial Sequence; identical to SEQ ID NO: 43114
  hemagglutinin__InfluenzaA__AJI80256

SEQ ID NO: 43318 - RNA, 1701 nt, Artificial Sequence; identical to SEQ ID NO: 40647
  hemagglutinin__InfluenzaA__AJI80268

SEQ ID NO: 43319 - RNA, 1701 nt, Artificial Sequence
  hemagglutinin__InfluenzaA__AJI80280
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauagguaaaauaugcgacaguccucaucagauccuugauggagaaaacugcacacuaauagaugcucuauugggagacccucagugugauggcuuucaaaauaaggaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggaggauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaggcauugaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43320 - RNA, 1701 nt, Artificial Sequence; identical to SEQ ID NO: 43102
  hemagglutinin__InfluenzaA__AJI80292

SEQ ID NO: 43321 - RNA, 1701 nt, Artificial Sequence; identical to SEQ ID NO: 43166
  hemagglutinin__InfluenzaA__AJI80303

SEQ ID NO: 43322 - RNA, 1701 nt, Artificial Sequence; identical to SEQ ID NO: 43102
  hemagglutinin__InfluenzaA__AJI80315

SEQ ID NO: 43323 - RNA, 1701 nt, Artificial Sequence
  hemagglutinin__InfluenzaA__AJI80326
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaaaaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43324 - RNA, 1701 nt, Artificial Sequence
  hemagglutinin__InfluenzaA__AJI80337
augaaggcaauacuaguaguucugcuauacacauuugcaaccgcaaaugcagacacauuauguauagguuaucaugcgaacaauucaacagacacuguagacacaguacuagaaaagaauguaacaguaacacacucuauuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcaaaugcauauguuuuuguggggacaucaaaauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaauaucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaucaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43325 - RNA, 1701 nt, Artificial Sequence; identical to SEQ ID NO: 43314
  hemagglutinin__InfluenzaA__AJI80348

SEQ ID NO: 43326 - RNA, 1701 nt, Artificial Sequence; identical to SEQ ID NO: 43171
  hemagglutinin__InfluenzaA__AJI80360

SEQ ID NO: 43327 - RNA, 1701 nt, Artificial Sequence; identical to SEQ ID NO: 43114
  hemagglutinin__InfluenzaA__AJI80372

SEQ ID NO: 43328 - RNA, 1701 nt, Artificial Sequence; identical to SEQ ID NO: 43132
  hemagglutinin__InfluenzaA__AJI80384

SEQ ID NO: 43329 - RNA, 1701 nt, Artificial Sequence; identical to SEQ ID NO: 43132
  hemagglutinin__InfluenzaA__AJI80395

SEQ ID NO: 43330 - RNA, 1701 nt, Artificial Sequence; identical to SEQ ID NO: 43132
  hemagglutinin__InfluenzaA__AJI80406

SEQ ID NO: 43331 - RNA, 1701 nt, Artificial Sequence; identical to SEQ ID NO: 43132
  hemagglutinin__InfluenzaA__AJI80417

SEQ ID NO: 43332 - RNA, 1701 nt, Artificial Sequence; identical to SEQ ID NO: 43086
  hemagglutinin__InfluenzaA__AJI80428

SEQ ID NO: 43333 - RNA, 1701 nt, Artificial Sequence
  hemagglutinin__InfluenzaA__AJI80439
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucagacaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcagcugagggaaaaugcugaggauaugggcaaugguuguuucaaaauauaccacaaaugugacaaugccugcauaggaucaaucagaaauggaacuuaugaccacgauguauacagggaugaggcauugaacaaccgguuccagaucaagggaguugaguugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43334 - RNA, 1701 nt, Artificial Sequence; identical to SEQ ID NO: 43105
  hemagglutinin__InfluenzaA__AJI80462

SEQ ID NO: 43335 - RNA, 1701 nt, Artificial Sequence
  hemagglutinin__InfluenzaA__AJI80474
augaaggcaauacuaguaguucugcuauauacauuugcaaccgcaaaugcagacacauuauguauagguuaucaugcgaacaauucaacagacacuguagauacaguacuagaaaagaauguaacaguaacacacucuauuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauccaccauccaucuacuacugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaauguagaauauguauuuaa

SEQ ID NO: 43336 - RNA, 1701 nt, Artificial Sequence; identical to SEQ ID NO: 43335
  hemagglutinin__InfluenzaA__AJI80485

SEQ ID NO: 43337 - RNA, 1701 nt, Artificial Sequence; identical to SEQ ID NO: 43132
  hemagglutinin__InfluenzaA__AJI80496

SEQ ID NO: 43338 - RNA, 1701 nt, Artificial Sequence; identical to SEQ ID NO: 43147
  hemagglutinin__InfluenzaA__AJI80507

SEQ ID NO: 43339 - RNA, 1701 nt, Artificial Sequence; identical to SEQ ID NO: 43132
  hemagglutinin__InfluenzaA__AJI80518

SEQ ID NO: 43340 - RNA, 1701 nt, Artificial Sequence
  hemagglutinin__InfluenzaA__AJJ98765
augaagacuaucauugcuuugagcuacauucuaugucugguguucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggaccggagucacucaaaacggaacaagcucugcuugcauaaggagaucuaauaauaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugccccuagggguuacuucaaaauacgaagugggaaaagcucaauaaugagaucagaugcacccauuggcaaaugcaacucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43341 - RNA, 1701 nt, Artificial Sequence
  hemagglutinin__InfluenzaA__AJJ98777
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuucucaacaggugaaauaugcaacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccagauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaaacaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggauaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgauuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43342 - RNA, 1701 nt, Artificial Sequence
  hemagglutinin__InfluenzaA__AJJ98789
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggauacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43343 - RNA, 1701 nt, Artificial Sequence
  hemagglutinin__InfluenzaA__AJJ98801
augaagacuaucauugcuuugagcuacauucuaugucugguuuucgcucaaaaacuuccuggaaaugacaauagcacggcaacgcugugccuugggcaccaugcaguaccaaacggaacgauagugaagacaaucacgaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaaacaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43344 - RNA, 1701 nt, Artificial Sequence
  hemagglutinin__InfluenzaA__AJJ98813
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguagucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43345 - RNA, 1701 nt, Artificial Sequence
  hemagglutinin__InfluenzaA__AJJ98825
augaagacuaucauugcuuugagcuacauucuaugucugguuuucgcucaagaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacacagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucagacaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43346 - RNA, 1701 nt, Artificial Sequence
  hemagglutinin__InfluenzaA__AJJ98837
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacggagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaagcacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43347 - RNA, 1701 nt, Artificial Sequence
  hemagglutinin__InfluenzaA__AJJ98849
augaagacuaucauugcuuugagcuacauucuaugucugguuuucgcucaagaacuuccuggaaaugacaacagcacggcaacgcugugccuugggcaccaugcagugccaaacggaacgauagugaaaacaaucacgaaugaccaaauugaagucacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaguacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacucagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaacgggaagcugaauagauugaucgggaaaaccaacgagaaauuccaucagauugaaaaagaauucucagaagucgaagggagaauucaggaccuugagaaauauguugaggacacuaaaauagaucucuggucauacaaugcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43348 - RNA, 1701 nt, Artificial Sequence
  hemagglutinin__InfluenzaA__AJJ98861
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaaugugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugaaaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaccaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43349 - RNA, 1701 nt, Artificial Sequence
  hemagglutinin__InfluenzaA__AJJ98873
augaagacuaucauugcuuugagcuacagucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucacuuaggucacuaguugccucauccggcacacuggaguuuaacaaugaaagcuucaauuggacuggagucacucaaaacggaacaagcucugcuugcauaaggaaaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauucuauggauuuccuuugccauaucauguuuuuugcuuuguguugcuuuguugggguucaucaugugggccugccaaaaaggcaacauuaggugcaacauuugcauuuga

SEQ ID NO: 43350 - RNA, 1701 nt, Artificial Sequence
  hemagglutinin__InfluenzaA__AJJ98885
augaagacuaucauugcuuugagcaacauucuaugucugguuuucgcucaaaaacuuccuggaaaugacaacagcacggcaacgcugugccuugggcaccaugcaguaccaaauggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggaggucuaauaacaguuucuuuaguagauugaauugguugacccacuuaaaauucaaauacccagcauugaacgugacuaugccaaacaaagaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaggaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43351 - RNA, 1701 nt, Artificial Sequence
  hemagglutinin__InfluenzaA__AJJ98897
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccccagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauagcaguuucuuuaguagauugaauugguugacccacuuaaaauucaaauauccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagaaaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaguagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaauaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43352 - RNA, 1701 nt, Artificial Sequence
  hemagglutinin__InfluenzaA__AJJ98909
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaguccucaucagauccuugauggagaaaacuguacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccuggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccaaaugacaaaccauuccaaaauguaaacaggaucacauacggggccugucccagauauguuaagcaaagcacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43353 - RNA, 1701 nt, Artificial Sequence
  hemagglutinin__InfluenzaA__AJJ98921
augaagacuaucauugcuuugagcuacauucuaugucugguuuucgcucaaaaacuuccuggaaaagacaacagcacggcaacgcugugccuugggcaccaugcaguaccaaacggaacgauagugaaaacaaucacgaaugaccaaauugaaguuacuaaugcuacugaacugguucagaguuccucaacaggugaaauaugcaacaguccucaucagauccuugauggagaaaacugcacacuaauagaugcucuauugggagacccucagugugauggcuuccaaaauaagaagugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucaagcaaaacggaacaagcucugcuugcauaaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43354 - RNA, 1701 nt, Artificial Sequence
  hemagglutinin__InfluenzaA__AJJ98933
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuugcguugcuuuguugggguucaucaugugggccugccaaaagggcaacauuaggugcaacauuugcauuuga

SEQ ID NO: 43355 - RNA, 1701 nt, Artificial Sequence; identical to SEQ ID NO: 41100
  hemagglutinin__InfluenzaA__AJJ98945

SEQ ID NO: 43356 - RNA, 1701 nt, Artificial Sequence
  hemagglutinin__InfluenzaA__AJJ98957
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggaccggagucacucaaaacggaacaagcucugcuugcauaaggagaucuaauaacaguuucuuuaguagauugaauugguugacccacucaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaacucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43357 - RNA, 1701 nt, Artificial Sequence
  hemagglutinin__InfluenzaA__AJJ98969
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaaguucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43358 - RNA, 1701 nt, Artificial Sequence
  hemagglutinin__InfluenzaA__AJJ98981
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucauauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaauggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaaugucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggauaacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43359 - RNA, 1701 nt, Artificial Sequence
  hemagglutinin__InfluenzaA__AJJ98993
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaauaggugaaauaugcgacaauccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcaugaggagaucuaauaguaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43360 - RNA, 1701 nt, Artificial Sequence
  hemagglutinin__InfluenzaA__AJJ99005
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggauuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43361 - RNA, 1701 nt, Artificial Sequence
  hemagglutinin__InfluenzaA__AJJ99017
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauuaggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucucguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43362 - RNA, 1701 nt, Artificial Sequence
  hemagglutinin__InfluenzaA__AJJ99029
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuauugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucuucuugcauaaggagaucuaauaacaguuucuuuaguagauugaauugguugacccauuuaaaauucaaauacccagcauugaaugugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43363 - RNA, 1701 nt, Artificial Sequence
  hemagglutinin__InfluenzaA__AJJ99041
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacagcccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacgggagucacucaaaauggaacaagcucugcuugcaaaaggggaucugauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuucccguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucuggaugcaucacuccaaauggaagcauucccaaugacaaaccauuucaaaauguaaacaggaucacauauggggccugucccagauauguuaagcaaagcacccugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagauugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggcuacaaagauuggauccuauggauuuccuuugccauaucauguuuuuugcuuuguguugcuuuguugggguucaucaugugggccugccaaaaaggcaacauuaggugcaacauuugcauuuaa

SEQ ID NO: 43364 - RNA, 1701 nt, Artificial Sequence; identical to SEQ ID NO: 40640
  hemagglutinin__InfluenzaA__AJJ99053

SEQ ID NO: 43365 - RNA, 1701 nt, Artificial Sequence; identical to SEQ ID NO: 40640
  hemagglutinin__InfluenzaA__AJJ99065

SEQ ID NO: 43366 - RNA, 1701 nt, Artificial Sequence
  hemagglutinin__InfluenzaA__AJJ99089
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaaacaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacaggaaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43367 - RNA, 1701 nt, Artificial Sequence; identical to SEQ ID NO: 40052
  hemagglutinin__InfluenzaA__AJJ99101

SEQ ID NO: 43368 - RNA, 1701 nt, Artificial Sequence; identical to SEQ ID NO: 39963
  hemagglutinin__InfluenzaA__AJJ99113

SEQ ID NO: 43369 - RNA, 1701 nt, Artificial Sequence
  hemagglutinin__InfluenzaA__AJJ99125
augaagacuaucauugcuuugagcuacauucuauguaugguuuucgcucaaaaacuuccuggaaaugacaacagcacggcaacgcugugccuugggcaccaugcagugccaaacggaacgauagugaaaacaaucacgaaugaccaaauugaaguuaccaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaguaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccguuuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43370 - RNA, 1701 nt, Artificial Sequence
  hemagglutinin__InfluenzaA__AJJ99137
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaguaucgaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcucuguugggguucaucaugugggccugccaaaaaggcaacauuaggugcaacauuugcauuuga

SEQ ID NO: 43371 - RNA, 1701 nt, Artificial Sequence
  hemagglutinin__InfluenzaA__AJJ99149
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguucaucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugauaugccggauuaugccucccuuaggucacuaguugccucaucuggcacacuggaguuuaacaaugaaagcuucaauuggacuggagucacucaaaacggaacaagcucugcuugcauaaggagaucuaauaguaguuucuuuaguagauugaauugguugacccacuuaaacuucaaauaccaagcauugaacgugacuaugccgaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagaccccgaguaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucugacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugccuuguugggguucaucaugugggccugccaaaaaggcaacauuaggugcaacauuugcauuuga

SEQ ID NO: 43372 - RNA, 1701 nt, Artificial Sequence
  hemagglutinin__InfluenzaA__AJJ99161
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggaccggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaacucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaaacugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43373 - RNA, 1701 nt, Artificial Sequence
  hemagglutinin__InfluenzaA__AJJ99173
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcaacagcccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauagcaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaaacaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacgaagaagcaacugagggaaaaugcugaggauaugggcaaugguuguuucagaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43374 - RNA, 1701 nt, Artificial Sequence
  hemagglutinin__InfluenzaA__AJJ99185
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggggucacucaaaacggaacaagcucugcuugcauaaggaaaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagagcagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43375 - RNA, 1701 nt, Artificial Sequence
  hemagglutinin__InfluenzaA__AJJ99197
augaagacuaucauugcuuugagcuacauucuauguuugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaacaauaguuucuuuaguagauugaauugguugacccacuuaaaauucaaauacccagcauugaacgugacuaugccaaacaaugaagaauuugacaaauuguacauuugggggguucaccacccggguacggacaaugaccaaaucuuccuguaugcccaagcaucaggaagaaucacagucucuaccaaaagaagccaacaaacuguaaucccgaauauuggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43376 - RNA, 1701 nt, Artificial Sequence
  hemagglutinin__InfluenzaA__AJJ99209
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacgggagucacucaaaauggaacaagcucugcuugcaaaaggaaaucugauaacaguuucuuuaguagauugaauugguugacccacuuaaaauucaaauacccagcauugaacgugacuaugccaaacaaugaagaauuugacaaauuguacauuugggggguucaccacccggggacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccuggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacagaaucacauauggggccugucccagauauguuaagcaaagcacccugaaauuggcaacagggaugcgaaauguaccggagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggcuacaaagauuggauccuauggauuuccuuugccaugucauguuuuuugcuuuguguugcuuuguugggguucaucaugugggccugccaaaaaggcaacauuaggugcaacauuugcauuuga

SEQ ID NO: 43377 - RNA, 1701 nt, Artificial Sequence
  hemagglutinin__InfluenzaA__AJJ99221
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaguaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccaaauaucggaucuagacccagaguaaggaauauccccagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacccaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaucaacauacaauugaucuaacugacucagaaaugaacaaacuguuugaaaaaacaaaaaagcaacugagggaaaacgcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43378 - RNA, 1701 nt, Artificial Sequence
  hemagglutinin__InfluenzaA__AJJ99233
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccaaauaucggaucuagacccagaguaaggaauauccccagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacccaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaucaacauacaauugaucuaacugacucagaaaugaacaaacuguuugaaaaaacaaaaaagcaacugagggaaaacgcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43379 - RNA, 1701 nt, Artificial Sequence
  hemagglutinin__InfluenzaA__AJJ99244
augaaggcaauacuaguagucaugcuguauacauuugcaaccgcaaaugcagacacauuauguauagguuaucaugcgaacaauucaacagacacuguagacacaguacuagaaaagaauguaacaguaacacacucuguuaaucuucuagaagacaaacauaacgggaaacuaugcaaacuaagagggguagccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaagagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaaguaagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccaaauuuuggcgaucuauucaacugucgcuaguucauugguacugguagucucccugggggcaaucaguuuuuggaugugcucuaaugggucucuacaguguagaauauguauuuaa

SEQ ID NO: 43380 - RNA, 1701 nt, Artificial Sequence
  hemagglutinin__InfluenzaA__AJJ99255
augaaggcaauacuaguaguucugcuauauacauuugcaaccgcaaaugcagacacauuauguauagguuaucaugcgaacaauucaacagacacuguagacacaguacuagaaaagaauguaacaguaacucacucuguuaaccuucuagaagacaaucauaacgggaaacuaugcaaacuaagagggguagccccauugcauuuggguaaauguaacauugcgggcuggauccugggaaauccagagugugaaucacucuccacagcaagcucaugguccuacauuguggaaacaucuagcucagacaauggaacguguuacccaggagauuucaucaauuaugaggagcuaagagagcaauugagcucagugucaucauuugaaagguuugaaauauuccccaagacaaguucauggcccaaucaugacucgaacaaagguguaacggcagcauguccucgugcuggagcaaaaagcuucuacaaaaauuuaauauggcuaguuaaaaaaggaaauucauacccaaagcucagcaaauccuacauuaaugauaaagggaaagaaguccucgugauguggggcauucaccauccaucuacuacugcugaccaacaaagucucuaucagaaugcagaugcauauguuuuuguggggacaucaagauacagcaaggaguucaagccggaaauagcaauaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggagccauugccggcuucauugaagggggguggacagggaugguagauggaugguacgguuaucaccaucaaaaugagcaggggucaggauaugcagccgaccugaagagcacacagaaugccaucgacaagauuaccaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43381 - RNA, 1698 nt, Artificial Sequence
  hemagglutinin__InfluenzaA__AJJ99267
augaaaguaaaacuacugguccuguuaugcacauuuacagcuacauaugcagacacaauauguauaggcuaccaugcuaacaacucgaccgacacuguugacacagugcuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucguuugagagguucgaaauauuccccaaagaaagcucauggcccaaccacaccauaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacuauaauauuugaggcaaauggaaaucuaauagcgccaagauaugcuuucgcacugaguagaggcuuuggaucaggaaucaucaacucaaaugcaccaauggacaaaugugaugcgaagugccaaacaccucagggagcuauaaacagcagucuuccuuuccagaacguacacccaguaacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggaguuuaucagauucuagcgaucuacucaacggucgccaguucucugguucuuuuggucucccugggggcagucagcuucuggauguguuccaaugggucuuugcaguguagaguaugcaucuaa

SEQ ID NO: 43382 - RNA, 1701 nt, Artificial Sequence
  hemagglutinin__InfluenzaA__AJJ99278
augaaggcaauacuaguaguucugcuauauacauuugcaaccgcaaaugcagacacauuauguauagguuaucaugcgaacaauucaacagauacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43383 - RNA, 1701 nt, Artificial Sequence
  hemagglutinin__InfluenzaA__AJJ99289
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaguuuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuauaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43384 - RNA, 1698 nt, Artificial Sequence
  hemagglutinin__InfluenzaA__AJJ99301
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaaucacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaauuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 43385 - RNA, 1698 nt, Artificial Sequence
  hemagglutinin__InfluenzaA__AJJ99324
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccaggacauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagagugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 43386 - RNA, 1701 nt, Artificial Sequence
  hemagglutinin__InfluenzaA__AJJ99335
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaaacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaauggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43387 - RNA, 1701 nt, Artificial Sequence
  hemagglutinin__InfluenzaA__AJJ99357
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagaaugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43388 - RNA, 1701 nt, Artificial Sequence
  hemagglutinin__InfluenzaA__AJJ99368
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucauggucauacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucguacuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagaugggugguacgguuaccaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaaggaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 43389 - RNA, 1701 nt, Artificial Sequence
  hemagglutinin__InfluenzaA__AJJ99379
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauugggaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 43390 - RNA, 1701 nt, Artificial Sequence
  hemagglutinin__InfluenzaA__AJJ99390
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagaggaguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacagcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaaugcccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacaagauuaccaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43391 - RNA, 1701 nt, Artificial Sequence
  hemagglutinin__InfluenzaA__AJJ99401
augaaggcaauacuaguaguucugcuauauacauuugcaacugcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43392 - RNA, 1698 nt, Artificial Sequence
  hemagglutinin__InfluenzaA__AJJ99413
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauugcugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaaucugcuauggcugacggggaagaaugguuuguacccaaaccugagcaaguccuaugcaaacaacaaagaaaaagaaguccuuguacuaugggguguucaucacccgccaaacauagcugaccaaaaaacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaucaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcaguaggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 43393 - RNA, 1698 nt, Artificial Sequence
  hemagglutinin__InfluenzaA__AJJ99425
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcaguaggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 43394 - RNA, 1698 nt, Artificial Sequence
  hemagglutinin__InfluenzaA__AJJ99437
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagagagcaauugaguucaguaucuucauuugaaagguucgaaauauuccccaaagaaagcucauggcccaaccacaccguaaccggagugucagcaucaugcucccauaauggggaaaacaguuuuuacagaaauuugcuauggcugacggggaagaaugguuuguacccaagccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaacaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 43395 - RNA, 1698 nt, Artificial Sequence
  hemagglutinin__InfluenzaA__AJJ99449
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaagaacugagggagcaauugaguucaguaucuucauuugagagguucgaaauauuucccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccaaagaaucaaaguuaaacagggagaaaauugacggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 43396 - RNA, 1698 nt, Artificial Sequence
  hemagglutinin__InfluenzaA__AJJ99461
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucguuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacuauaauauuugaggcaaauggaaaucuaauagcgccaagauaugcuuucgcacugaguagaggcuuuggaucaggaaucaucaacucaaaugcaccaauggacaaaugugaugcgaagugccaaacaccucagggagcuauaaacagcagucuuccuuuccagaacguacacccaguaacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuagcgaucuacucaacagucgccaguucucugguucuuuuggucucccugggggcaaucagcuucuggauguguuccaaugggucuuugcaguguagaauaugcaucuaa

SEQ ID NO: 43397 - RNA, 1701 nt, Artificial Sequence
  hemagglutinin__InfluenzaA__AJJ99483
augaaggcaauacuauuaguucugcuauauacauuugcaaccgcaaaugcagacacauuauguauagguuaucaugcgaacaauucaacagacacuguagacacaguacuagaaaagaauguaacaguaacucacucuguuaaccuucuagaagacaagcauaacgggaaacuaugcaaacuaagagggguagccccauugcauuuggguaaauguaacauugcgggcuggauccugggaaauccagagugugaaucacucuccacagcaagcucaugguccuacauuguggaaacaucuagcucagacaauggaacguguuacccaggagauuucaucaauuaugaggagcuaagagagcaauugagcucagugucaucauuugaaagguuugaaauauuccccaagacaaguucauggcccaaucaugacucgaacaaagguguaacggcagcauguccucgugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggagccauugccggcuucauugaagggggguggacagggaugguagauggaugguacgguuaucaccaucaaaaugagcaggggucaggauaugcagccgaccugaagagcacacagaaugccaucgacaaaauuaccaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43398 - RNA, 1701 nt, Artificial Sequence
  hemagglutinin__InfluenzaA__AJJ99494
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaguuuucaucgauuaugaggagcuaagagagcaauuaagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccauccacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43399 - RNA, 1701 nt, Artificial Sequence
  hemagglutinin__InfluenzaA__AJJ99505
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaaggguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43400 - RNA, 1701 nt, Artificial Sequence; identical to SEQ ID NO: 35277
  hemagglutinin__InfluenzaA__AJJ99516

SEQ ID NO: 43401 - RNA, 1701 nt, Artificial Sequence
  hemagglutinin__InfluenzaA__AJJ99527
augaaggcaauacuauuaguucugcuauauacauuugcaaccgcaaaugcagacacauuauguauagguuaucaugcgaacaauucaacagacacuguagacacaguacuagaaaagaauguaacaguaacucacucuguuaaccuucuagaagacaagcauaacgggaaacuaugcaaacuaagagggguagccccauugcauuuggguaaauguaacauugcgggcuggauccugggaaauccagagugugaaucacucuccacagcaagcucaugguccuacauuguggaaacaucuagcucagacaauggaacguguuacccaggagauuucaucaauuaugaggagcuaagagagcaauugagcucagugucaucauuugaaagguuugaaauauuccccaagacaaguucauggcccaaucaugacucgaacaaagguguaacggcagcauguccucgugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggagccauugccggcuucauugaagggggguggacagggaugguggauggaugguacgguuaucaccaucaaaaugagcaggggucaggauaugcagccgaccugaagagcacacagaaugucaucgacaaaauuaccaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaagaauuuaccagauuuuggcgaucuauucaacugucgccaguucauuaguacugguagucucccugggggcaaucaguuucuggaugugcucuaaugggucucuacaguguagaauauguauuuaa

SEQ ID NO: 43402 - RNA, 1701 nt, Artificial Sequence
  hemagglutinin__InfluenzaA__AJJ99538
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggaacuaagggagcaauugagcucagugucaucauuugaaagguuugagauauuccccaagacaaguucauggcccaaucaugauucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaucauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguaugguuaucaccaucaaaaugagcaggggucaggauaugcagccgaccugaagagcacacagaaugccauugacaagaucacuaacaaaguaaauucaguuauugaaaagaugaauacacaguucacagcaguagguaaagaguucaaccaccuggaaaaaagaauagagaauuuaaauaaaaaagucgaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaacuggaaauggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 43403 - RNA, 1701 nt, Artificial Sequence
  hemagglutinin__InfluenzaA__AJJ99549
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagcugaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacaugugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 43404 - RNA, 1701 nt, Artificial Sequence
  hemagglutinin__InfluenzaA__AJJ99560
augaaggcaauacuaguaguucugcuauauacauuugcaaccgcaaaugcagacacauuauguauagguuaucaugcgaacaauucaacagacacuguagacacaguacuagaaaagaauguaacaguaacacacucugucaaccuucuagaagacaagcauaacgggaaacuaugcaagcuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagagaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaucacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauuaguacugguagucucccugggggcaaucaguuucuggaugugcucuaaugggucucuacaguguagaauauguauuuaa

SEQ ID NO: 43405 - RNA, 1701 nt, Artificial Sequence
  hemagglutinin__InfluenzaA__AJJ99571
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauauacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 43406 - RNA, 1701 nt, Artificial Sequence
  hemagglutinin__InfluenzaA__AJJ99582
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaauggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43407 - RNA, 1701 nt, Artificial Sequence; identical to SEQ ID NO: 35277
  hemagglutinin__InfluenzaA__AJJ99593

SEQ ID NO: 43408 - RNA, 1701 nt, Artificial Sequence
  hemagglutinin__InfluenzaA__AJJ99604
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuaggaaauccagaaugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccagagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43409 - RNA, 1698 nt, Artificial Sequence
  hemagglutinin__InfluenzaA__AJJ99616
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccgggacauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcuaaccaaaagacccucuaccauacagaaaaugcuuauguuucuguagugucuucacauuauagcagaaaauuaaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggauuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 43410 - RNA, 1698 nt, Artificial Sequence; identical to SEQ ID NO: 38239
  hemagglutinin__InfluenzaA__AJJ99628

SEQ ID NO: 43411 - RNA, 1698 nt, Artificial Sequence
  hemagglutinin__InfluenzaA__AJJ99640
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcuaaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccguugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggauuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucucuuggucucccugggggcaaucagcuucuggauguguuccaaugggucuuugcaguguagaauaugcaucuaa

SEQ ID NO: 43412 - RNA, 1698 nt, Artificial Sequence
  hemagglutinin__InfluenzaA__AJJ99652
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggauuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 43413 - RNA, 1698 nt, Artificial Sequence
  hemagglutinin__InfluenzaA__AJJ99664
augaaagcaaaacuacugguccuguuaugcacauucacagcuacauaugcagacacaauauguauaggcuaccaugcuaacaacucgaccgacacuguugacacaguacuugaaaagaaugugacagugacacacucugucaaccugcuugagaacagucacaauggaaaauuaugucuauuaaaaggaauagccccacuacaauuggguaauugcagcauugccggguggaucuuaggaaauccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaauaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuuacaguguagaauaugcaucuaa

SEQ ID NO: 43414 - RNA, 1701 nt, Artificial Sequence
  hemagglutinin__InfluenzaA__AJJ99675
augaaggcaauacuauuaguucugcuauauacauuugcaaccgcaaaggcagacacauuauguauagguuaucaugcgaacaauucaacagacacuguagacacaguacuagaaaagaauguaacaguaacucacucuguuaaccuucuagaagacaagcauaacgggaaacuaugcaaacuaagagggguagccccauugcauuuggguaaauguaacauugcgggcuggauccugggaaauccagagugugaaucacucuccacagcaagcucaugguccuacauuguggaaacaucuagcucagacaauggaacguguuacccaggagauuucaucaauuaugaggagcuaagagagcaauugagcucagugucaucauuugaaagguuugaaauauuccccaagacaaguucauggcccaaucaugacucgaacaaagguguaacggcagcauguccucgugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggagccauugccggcuucauugaagggggguggacagggaugguagauggaugguacgguuaucaccaucaaaaugagcaggggucaggauaugcagccgaccugaagagcacacagaaugccaucgacaaaauuaccgacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43415 - RNA, 1701 nt, Artificial Sequence
  hemagglutinin__InfluenzaA__AJJ99686
augacggcaauacuauuaguucugcuauauacauuugcaaccgcaaaugcagacacauuauguauagguuaucaugcgaacaauucaacagacacuguagacacaguacuagaaaagaauguaacaguaacucacucuguuaaccuucuagaagacaagcauaacgggaaacuaugcaaacuaagagggguagccccauugcauuuggguaaauguaacauugcgggcuggaucuugggaaauccagagugugaaucacucuccacagcaagcucaugguccuacauuguggaaacaucuagcucagacaauggaacguguuacccaggagauuucaucaauuaugaggagcuaagagagcaauugagcucagugucaucauuugaaagguuugaaauauuccccaagacaaguucauggcccaaucaugacucgaacaaagguguaacggcagcauguccucgugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggagccauugccggcuucauugaagggggguggacagggaugguagauggaugguacgguuaucaccaucaaaaugagcaggggucaggauaugcagccgaccugaagagcacacagaaugccaucgacaaaauuaccaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguuaguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43416 - RNA, 1701 nt, Artificial Sequence
  hemagglutinin__InfluenzaA__AJJ99697
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggaacuaagggagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacugggaaucuagugguaccgagauaugcauucguaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucaguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaacuggaaauggcugcuuugaauuuuaccacaaaugcgauaacacgugcauggaaagugucaaaaaugggacuuaugacuacccaaaguacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 43417 - RNA, 1701 nt, Artificial Sequence
  hemagglutinin__InfluenzaA__AJJ99708
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggaacuaagggagcaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacugggaaucuagugguaccgagauaugcauucguaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucaguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaacuggaaauggcugcuuugaauuuuaccacaaaugcgauaacacgugcauggaaagugucaaaaaugggacuuaugacuacccaaaguacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 43418 - RNA, 1701 nt, Artificial Sequence
  hemagglutinin__InfluenzaA__AJJ99719
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucguacuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagaaccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagcugaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaggggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 43419 - RNA, 1701 nt, Artificial Sequence
  hemagglutinin__InfluenzaA__AJJ99730
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucguacuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagaugggugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuucaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 43420 - RNA, 1701 nt, Artificial Sequence; identical to SEQ ID NO: 37546
  hemagglutinin__InfluenzaA__AJJ99741

SEQ ID NO: 43421 - RNA, 1701 nt, Artificial Sequence; identical to SEQ ID NO: 35712
  hemagglutinin__InfluenzaA__AJJ99752

SEQ ID NO: 43422 - RNA, 1701 nt, Artificial Sequence
  hemagglutinin__InfluenzaA__AJJ99763
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacuucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacagcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcgauaaacaccagccuaccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43423 - RNA, 1698 nt, Artificial Sequence
  hemagglutinin__InfluenzaA__AJJ99775
augaaaguaaaacuauugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauugcugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguucuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaacggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcauuuaa

SEQ ID NO: 43424 - RNA, 1701 nt, Artificial Sequence
  hemagglutinin__InfluenzaA__AJJ99786
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaaacauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucagcugucgccaguucauugguacugguagucucccugggggcaaucaguuucuggaugugcucuaaugggucucuacaguguagaauauguauuuaa

SEQ ID NO: 43425 - RNA, 1698 nt, Artificial Sequence
  hemagglutinin__InfluenzaA__AJJ99798
augaaaguaaaacuacugguccuguuaugcacauuuacagcuacauaugcagacacaauauguauaggcuaccaugcuaacaacucgaccgauacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaagaccaaauccugaaaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucauccgccaaacauagcuaaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauguuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaacggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 43426 - RNA, 1698 nt, Artificial Sequence
  hemagglutinin__InfluenzaA__AJJ99810
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaccaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcagugcagaauaugcaucuaa

SEQ ID NO: 43427 - RNA, 1698 nt, Artificial Sequence
  hemagglutinin__InfluenzaA__AJJ99822
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauucgagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuuugcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaauaugucaggagugcaaaauuaaggaugguuacaggacuaaggaacaucccauucauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 43428 - RNA, 1701 nt, Artificial Sequence
  hemagglutinin__InfluenzaA__AJJ99833
augaaggcaauacuauuaguucugcuauauacauuugcaaccgcaaaugcagacacauuauguauagguuaucaugcgaacaauucaacagacacuguagacacaguacuagaaaagaauguaacaguaacucacucuguuaaccuucuagaagacaagcauaacgggaaacuaugcaaacuaagagggguagccccauugcauuuggguaaauguaacauugcgggcuggauccugggaaauccagagugugaaucacucuccacagcaagcucaugguccuacauuguggaaacaucuagcucagacaauggaacguguuacccaggagauuucaucaauuaugaggagcuaagagagcaauugagcucagugucaucauuugaaagguuugaaauauuccccaagacaaguucauggcccaaucaugacucgaacaaagguguaacggcagcauguccucgugcuggagcaaaaagcuucuacaaaaauuuaauauggcuaguuaaaaaaggaaauucauaccuaaagcucagcaaauccuacauuaaugauaaagggaaagaaguccucgugcuguggggcauucaccauccaucuacuacugcugaccaacaaagucucuaucagaaugcagaugcauauguuuucguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggagccauugccggcuucauugaagggggguggacagggaugguagauggaugguacgguuaucaccaucaaaaugagcaggggucaggauaugcagccgaccugaagagcacacagaaugccaucgacaaaauuaccaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43429 - RNA, 1701 nt, Artificial Sequence
  hemagglutinin__InfluenzaA__AJJ99844
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucguacuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagaaccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccaugauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 43430 - RNA, 1701 nt, Artificial Sequence
  hemagglutinin__InfluenzaA__AJJ99855
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauagcacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 43431 - RNA, 1701 nt, Artificial Sequence
  hemagglutinin__InfluenzaA__AJJ99866
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaaaagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugacaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuagacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43432 - RNA, 1701 nt, Artificial Sequence
  hemagglutinin__InfluenzaA__AJJ99877
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucacaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaggaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43433 - RNA, 1701 nt, Artificial Sequence
  hemagglutinin__InfluenzaA__AJJ99888
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43434 - RNA, 1701 nt, Artificial Sequence
  hemagglutinin__InfluenzaA__AJJ99899
augaaggcaauacuaguaguucugcuauauacauuugcaaccgcaaaugcagacacauuauguauagguuaucaugcgaacaauucaacagacacuguagacacaguauuagaaaagaauguaacaguaacucacucuguuaaccuucuagaagacaagcauaacgggaaacuaugcaaacuaagagggguagccccauugcauuuggguaaauguaacauugcgggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugaaauauuccccaagacaaguucauggcccaaucaugacucgaacaaagguguaacggcagcauguccucgugcuggagcaaaaagcuucuacaaaaauuuaauauggcuaguuaaaaaaggaaauucauacccaaaccucagcaaauccuacauuaaugauaaagggaaagaaguccuugugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuauuagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggagccauugccggcuucauugaagggggguggacagggaugguagauggaugguacgguuaucaccaucaaaaugggcaggggucaggauaugcagccgaccugaagagcacacagaaugccguugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43435 - RNA, 1701 nt, Artificial Sequence
  hemagglutinin__InfluenzaA__AJJ99910
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggaacuaagggagcaauugagcucagugucaucauuugaaagguuugagauauuccccaagacaaguucauggcccaaucaugacucggacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaucauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucaguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaacuggaaauggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 43436 - RNA, 1701 nt, Artificial Sequence
  hemagglutinin__InfluenzaA__AJJ99921
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccgucuauucaaucuagaggccuauuuggggccauugccggcuucauugaagggggguggacagggaugguagauggaugguacgguuaccaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 43437 - RNA, 1701 nt, Artificial Sequence
  hemagglutinin__InfluenzaA__AJJ99932
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaaugugacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43438 - RNA, 1701 nt, Artificial Sequence; identical to SEQ ID NO: 37198
  hemagglutinin__InfluenzaA__AJJ99943

SEQ ID NO: 43439 - RNA, 1701 nt, Artificial Sequence
  hemagglutinin__InfluenzaA__AJJ99954
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauuugaaaaguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacagagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucacuucagauacaccaguccacgauugcaauacaacuugucagacacccaagggugcuauaaacaccagccucccauuucagaauauacauccgaucacaauuggaaacuguccaaaauauguaaaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucuuuacaguguagaauauguauuuaa

SEQ ID NO: 43440 - RNA, 1701 nt, Artificial Sequence; identical to SEQ ID NO: 35277
  hemagglutinin__InfluenzaA__AJJ99965

SEQ ID NO: 43441 - RNA, 1698 nt, Artificial Sequence
  hemagglutinin__InfluenzaA__AJJ99989
augaaaguaaaacuacugguccuguuaugcacauuuacagcuacauaugcagacacaauauguauaggcuaccaugcuaacaacucgaccgacacuguugacacaguacuugaaaggaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagagaaugcuuaugucucuguagugucuucacauuauagcaaaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaaggaggguggacuggaaugguagaugguugguaugguuaucaucaucagaaugagcaaggaucuggcuaugcugcagaucaaagaagcacacaaaaugccauuaaugggauuacaaacaaggugaauucuguaauugagaaaaugaacacucaauucacagcagugggcaaagaauucaacaaauuggaaagaagaauggaaaauuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugccaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 43442 - RNA, 1701 nt, Artificial Sequence
  hemagglutinin__InfluenzaA__AJK00001
augaaggcaauacuaguaguucugcuauauacauuugcaaccgcaaaugcagacacacuauguauagguuaucaugcgaacaauucaacagacacuguagacacaguacuagaaaagaauguaacaguaacucacucuguuaaccuucuagaagacaagcauaacgggaaacuaugcaaacuaagagggguagccccauugcauuuggguaaauguaacauugcgggcuggauccugggaaauccagagugugaaucacucuccacagcaagcucaugguccuacauuguggaaacaucuagcucagacaauggaacguguuacccaggagauuucaucaauuaugaggagcuaagagagcaauugagcucagugucaucauuugaaagguuugaaauauuccccaagacaaguucauggcccaaucaugacucgaacaaagguguaacggcagcauguccucgugcuggagaaaaaagcuucuacaaaaauuuaauauggcuaguuaaaaaagggaauucauacccaaagcucagcaaauccuacauuaaugauaaagggaaagaaguccucgugcuguggggcauucaccauccaucuacuacugccgaccaacaaagucucuaucagaaugcagaugcauauguuuuuguggggacaucaagauacagcaagaaguucaaaccggaaauagcaauaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggagccauugccggcuucauugaagggggguggacagggaugguagauggaugguacgguuaucaccaucaaaaugagcaggggucaggauaugcagccgaccugaagagcacacagaaugccaucgacaagauuaccaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43443 - RNA, 1701 nt, Artificial Sequence
  hemagglutinin__InfluenzaA__AJK00012
augaaggcaauacuaguaguuuugcuauguacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauuacauuugggaaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucaaaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaacaguccacgauugcaauacaacuugucagacacccaagggugcuauaaacaccagccuaccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucgaaugugaagaacuuauaugaaaagguaagaaaccaauuaaaaaacaaugccaaggaaauuggagauggcugcuuugaauuuuaccacaaaugcgauaacacgugcauggaaaguguuaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 43444 - RNA, 1701 nt, Artificial Sequence
  hemagglutinin__InfluenzaA__AJK00023
augaaggcaauacuaguaguucugcuauauacauuugcaaccgcaaaugcagacacauuauguauagguuaucaugcgaacaauucaacagacacuguagacacaguacuagaaaagaauguaacaguaacucacucuguuaaccuucuagaagacaagcauaacgggaaacuaugcaaacuaagagggguagccccauugcauuuggguaaauguaacauugcgggcuggauccugggaaauccagagugugaaucacucuccacagcaagcucaugguccuacauuguggaaacaucuagcucagacaauggaacguguuacccaggagauuucaucaauuaugaggagcuaagagagcaauugagcucagugucaucauuugaaagguuugaaauauuccccaagacaaguucauggcccaaucaugacucgaacaaagguguaacggcagcauguccucgugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggagccauugccggcuucauugaagggggguggacagggaugguagauggaugguacgguuaucaccaucaaaaugagcaggggucaggauaugcagccgaccugaagagcacacagaaugccaucgacaagauuaccaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguuuuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucacugguacugguagucucccugggggcaaucaguuucuggaugugcucuaaugggucucuacaguguagaauauguauuuaa

SEQ ID NO: 43445 - RNA, 1701 nt, Artificial Sequence
  hemagglutinin__InfluenzaA__AJK00034
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucguacuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 43446 - RNA, 1701 nt, Artificial Sequence; identical to SEQ ID NO: 37546
  hemagglutinin__InfluenzaA__AJK00045

SEQ ID NO: 43447 - RNA, 1701 nt, Artificial Sequence; identical to SEQ ID NO: 37546
  hemagglutinin__InfluenzaA__AJK00056

SEQ ID NO: 43448 - RNA, 1701 nt, Artificial Sequence; identical to SEQ ID NO: 35277
  hemagglutinin__InfluenzaA__AJK00067

SEQ ID NO: 43449 - RNA, 1698 nt, Artificial Sequence
  hemagglutinin__InfluenzaA__AJK00079
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacgaggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggauuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucucuuggucucccugggggcaaucagcuucuggauguguuccaaugggucuuugcaguguagaauaugcaucuaa

SEQ ID NO: 43450 - RNA, 1698 nt, Artificial Sequence
  hemagglutinin__InfluenzaA__AJK00091
augaaaguaaaacuacugguccuguuaugcacauuuacagcuacauaugcagacacaauauguauaggcuaccaugcuaacaacucgaccgacacuguugacacagugcuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucguuugagagguucgaaauauuccccaaagaaagcucauggcccaaccacaccauaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauagguguccaaaaggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacuauaauauuugaggcaaauggaaaucuaauagcgccaagauaugcuuucgcacugaguagaggcuuuggaucaggaaucaucaacucaaaugcaccaauggacaaaugugaugcgaagugccaaacaccucagggagcuauaaacagcagucuuccuuuccagaacguacacccaguaacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggaguuuaucagauucuagcgaucuacucaacggucgccaguucucugguucuuuuggucucccugggggcagucagcuucuggauguguuccaaugggucuuugcaguguagaguaugcaucuaa

SEQ ID NO: 43451 - RNA, 1698 nt, Artificial Sequence
  hemagglutinin__InfluenzaA__AJK00103
augaaaguaaaacuacugguccuguuaugcacauuuacagcuacauaugcagacacaauauguauaggcuaccaugcuaacaacucgaccgacacuguugacacagugcuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucguuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacuauaauauuugaggcaaauggaaaucuaauagcgccaagauaugcuuucgcacugaguagaggcuuuggaucaggaaucaucaacucaaaugcaccaauggacaaaugugaugcgaagugccaaacaccucagggagcuauaaacagcagucuuccuuuccagaacguacacccaguaacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuagcgaucuacucaacagucgccaguucucugguucuuuuggucucccugggggcaaucagcuucuggauguguuccaaugggucuuugcaguguagaauaugcaucuaa

SEQ ID NO: 43452 - RNA, 1701 nt, Artificial Sequence; identical to SEQ ID NO: 37547
  hemagglutinin__InfluenzaA__AJK00114

SEQ ID NO: 43453 - RNA, 1701 nt, Artificial Sequence
  hemagglutinin__InfluenzaA__AJK00125
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagagguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauuugaaagguuugagauauuccccaagacaaauucauggcccaaucaugauucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagucuacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43454 - RNA, 1701 nt, Artificial Sequence
  hemagglutinin__InfluenzaA__AJK00136
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcgauaaacacaagccuaccauuucagaauauacauccgaucacaauuggaaaauguccaaaauauguaaaaagcacaaaauugagacuggccacaggauugaggaaugucccgucuauucaaucuagaggccuauuuggggccauugcugguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43455 - RNA, 1704 nt, Artificial Sequence
  hemagglutinin__InfluenzaA__AJK00166
auggagaaaauagugcuucuucuugcaauagucagccuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucugauuuuaagagauuguaguguagcuggauggcuccucggaaacccaaugugugacgaauucaucaaugugccggaauggucuuacauaguggagaaggccaacccagccaaugaccucuguuacccagggaauuuuaacgacuaugaagaacugaaacaccuauugagcagaauaaaccauuuugagaaaauucagaucauccccaaaaguucuugguccgaucaugaagccucaucaggggugagcucagcauguccauaccagggaaagcccuccuuuuucagaaaugugguauggcuuaucaaaaagaacaauacauacccaacaauaaagagaagcuacaauaauaccaaccaggaagaucuuuugauacugugggggauucaucauucuaaugaugcggcagagcagacaaagcucuaucaaaacccaaccaccuauauuuccguugggacaucaacacuaaaccagagauugguaccaaaaauagcuacuagauccaaaguaaacgggcaaaguggaaggauggauuucuucuggacaauuuuaaaaccgaaugaugcaaucaacuucgagaguaauggaaauuucauugcuccagaauaugcauacaaaauugucaagaaaggggacucagcaauuaugaaaagugaaguggaauaugguaacugcaacacaaagugucaaacuccaauaggggcgauaaacucuaguaugccauuccacaacauacacccucucaccaucggggaaugccccaaauaugugaaaucaaacaaauuaguccuugcgacugggcucagaaauaguccucuaagagaaagaagaagaaaaagaggacuauuuggagcuauagcaggguuuauagagggaggauggcagggaaugguagaugguugguauggguaccaccauagcaaugagcaggggaguggguacgccgcagacaaagaauccacucaaaaggcaauagauggagucaccaauaaggucaacucgaucauugacaaaaugaacacucaguuugaggccguuggaagggaauuuaauaacuuagaaaggagaauagagaauuuaaacaagaaaauggaagacggauuccuagaugucuggacuuauaaugcugaacuucugguucucauggaaaaugagagaacucuagacuuccaugacucaaaugucaagaaccuuuacgacaagguccgacuacagcuuagggauaaugcaaaggagcuggguaacgguuguuucgaguucuaucacaaaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguugcgaguucucuagcacuggcaaucaugguggcuggucuaucuuuguggaugugcuccaaugggucguuacaaugcagaauuugcauuuaa

SEQ ID NO: 43456 - RNA, 1707 nt, Artificial Sequence
  hemagglutinin__InfluenzaA__AJK00177
auggagaaaauagugcuucuucuugcaguggucagccuuguuaggagugaucagauuugcauugguuaccaugcaaacaacucgacagagcagguugacacaauaauggaaaagaacgucacuguuacacaugcccaagauauacuggaaaagacacacaacgggaagcucugcgaucuagauggagugaagccucugauuuuaagagauuguaguguagcuggguggcuccucggaaacccaaugugugacgaauucaucaaugugccggaauggucuuacauaguggagaaggccaacccagccaaugaccucuguuacccagggaaucucaacgacuaugaagaacugaaacaccuauugagcagaauaaaccauuuugagaaaauucagaucauccccaaaaguucuugguccgaucaugaagccucauuaggggugagcucagcauguccauaccagggaacacccuccuuuuucagaaaugugguauggcuuaucaagaagaacaauacauacccaacaauaaagagaagcuacaauaauaccaaccaggaagaucuuuugauacugugggggauucaucauucuaaugaugaggcagagcagauaaagcucuaccaaaacccaaccaccuauguuuccguugggacaucaacacuaaaccagagauugguaccaaaaauagcuacuagauccaaaguaaacgggcaaaguggaagaauggauuucuucuggacaauuuuaaaaccggacgaugcaaucaacuucgagaguaauggaaauuucauugcuccagaauaugcauacaaaauugucaagaaaggagacucagcaauuaugaaaagugaaguggaauaugguaacugcaacaccaagugucaaacuccaauaggggcgauaaacucuaguaugccauuccacaacauacacccucucacuaucggggaaugccccaaauaugugaaaucaaacaaauuaguccuugcaacuggacucagaaauaguccucuaagagaaaaaagaagaagaaaaagaggacuauuuggagcuauagcagguuuuauagagggaggauggcagggaaugguagaugguugguauggguaccaccauagcaaugaacaggggaguggguacgcugcugacaaagaauccacucaaaaggcaauagauggagucaccaauaaggucaacucaaucauugacaaaaugaacacucaguuugaagccguuggaagggaauuuaauaacuuagaaaggagaauagagaauuuaaacaagaaaauggaagacggauuccuagaugucuggacuuauaaugcugaacuucugguucucauggaaaaugagagaacucuagacuuccaugacucaaaugucaagaaccuuuacgacaagguccgacuacagcuuagggauaaugcaaaggaacuggguaacgguuguuucgaguucuaucacaaaugugauaaugaaugcauggaaaguguaagaaacggaacguaugacuacccgcaguauucagaagaagcaagacuaaaaagagaggaaauaaguggaguaaaauuggaaucaauaggaauuuaccaaauacugucgauuuauucaacaguugcgaguucucuagcauuggcaaucaugguggcuggucuaucuuuauggaugugcuccaaugggucguuacaaugcagaauuugcauuuaa

SEQ ID NO: 43457 - RNA, 1704 nt, Artificial Sequence
  hemagglutinin__InfluenzaA__AJK00188
auggagaaaauagugcuucuucuugcaguggucagccuuguuagaagugaucagauuugcauugguuaccaugcaaacaacucgacagagcagguugacacaauaauggaaaaaaacguuacuguuacgcaugcccaagauauacuggaaaagacacacaacgggaagcucugcgaucuagauggagugaagccucugauuuuaagagauuguaguguagcuggauggcuccucggaaacccaaugugugacgaauucaucaaugugccggaauggucuuacauaguggagaaggccaacccagccaaugaccucuguuacccagggaaucucaacgacuaugaagaacugaaacaccuauugagcagaauaaaccauuuugagaaaauucagaucauccccaaaaguucuugguccgaucaugaagccucauuaggggugagcucagcauguccauaccagggaacacccuccuuuuucagaaaugugguauggcuuaucaagaagaacaauacauacccaacaauaaagagaagcuacaauaauaccaaccaggaagaucuuuugauacugugggggauucaucauucuaaugaugaggcagagcagauaaagcucuaccaaaacccaaccaccuauauuuccguugggacaucaacacuaaaccagagauugguaccaaaaauagcuacuagauccaaaguaaacgggcaaaguggaagaauggauuucuucuggacaauuuuaaaaccggacgaugcaaucaacuucgagaguaauggaaauuucauugcuccagaauaugcauacaaaauugucaagaaaggagacucagcaauuaugaaaagugaaguggaauaugguaacugcaacaccaagugucaaacuccaauaggggcgauaaacucuaguaugccauuccacaacauacacccucucacuaucggggaaugccccaaauauguaaaaucaaacaaauuaguccuugcaacuggacucagaaauaguccucuaagagaaaaaagaagaaaaagaggacuauuuggagcuauagcagguuuuauagagggaggauggcagggaaugguagaugguugguauggguaccaccauagcaaugagcaggggaguggguacgcugcugacaaagaauccacucaaaaggcaauagauggagucaccaauaaggucaacucgaucauugacaaaaugaacacucaguuugaagccguuggaagggaauuuaauaacuuagaaaggagaauagagaauuuaaacaagaaaauggaagacggauuccuagaugucuggacuuauaaugcugaacuucugguucucauggaaaaugagagaacucuagacuuccaugacucaaaugucaagaaccuuuacgacaagguccgacuacagcuuagggauaaugcaaaggaacuggguaacgguuguuucgaguucuaucacaaaugugauaaugaaugcauggaaaguguaagaaacggaacguaugacuacccgcaguauucagaagaagcaagauuaaaaagagaggaaauaaguggaguaaaauuggaaucaauaggaacuuaccaaauacugucgauuuauucaacaguugcgaguucucuagcacuggcaaucaugguggcuggucuaucuuuauggaugugcuccaaugggucguuacaaugcagaauuugcauuuaa

SEQ ID NO: 43458 - RNA, 1704 nt, Artificial Sequence
  hemagglutinin__InfluenzaA__AJK00207
auggagaaaauagugcuucuucuugcaauagucagccuuguuagaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccuuugauuuuaagagauuguaguguagcuggauggcuccucggaaacccaaugugugacgaauuuaucaaugugccagaauggucuuacauaguggagaaggccaacccagccaaugaccucuguuacccagggaauuucaacgacuaugaagaacugaaacaccuauugagcagaauaaaucauuuugagaaaauucagaucauccccaaaaguucuugguccgaucaugaagccucaucaggggugagcucagcauguccguaucagggaacgcccucuuuuuucaggaauguaguauggcuuaucaaaaagaacaauacauacccaacaauaaagagaagcuacaauaacaccagccaggaagaucuguugguacugugggggauucaccauucuaaugaugcgacagaacagaugaagcucuaucaaaacccaaccaccuauguuuccguuggaacaucaacacuaaaccagagauugguaccaaaaauagcuacuagauccaaaguaaacgggcaaaguggaaggauggauuucuucuggacaauuuuaaaaucgaaugaugcaaucaacuucgaaagcaaugggaauuucauugcuccagaauaugcauacaaaauugucaagaaaggggacucagcaauuaugaaaagugaaguggaauaugguaacugcagcaccaagugucaaacuccgauaggggcgauaaacucuaguaugccauuccacaauauacacccucucaccaucggggaaugccccaaauaugugaaaucaaacaaauuaguccuugcgacugggcucagaaauaguccucuaagagaaaggagaagaaaaagaggacuauuuggagcuauagcaggguuuauagagggaggauggcagggaaugguagaugguugguauggguaccaccauaguaaugagcaggggaguggguacgcugcagacaaagaauccacccaaaaggcaauagauggagucaccaauaaggucaacucuaucauugacaaaaugaacacucaguuugaggccguuggaagggaauuuaauaacuuagaaaggagaauagagaauuuaaacaagaaaauggaagacggauuccuagaugucuggacuuauaaugcugaacuucugguucucauggaaaaugagaggacucuagacuuccaugacucaaaugucaagaaccuuuacgacaagguccgacuacagcugagggauaauacaaaggagcuggguaacgguugcuucgaguucuaucacaaaugugauaaugaauguauggaaaguguaagaaacggaacguaugacuacccgcaguauucagaagaagcaagauuaaaaagagaggaaauuaguggaguaaaauuggaaucaauaggaacuuaccaaauacugucaauuuauucaacaguugcgaguucucuagcgcuggcaaucaugguggcuggucuaucuuuguggaugugcuccaaugggucguuacaaugcagaauuugcauuuaa

SEQ ID NO: 43459 - RNA, 1704 nt, Artificial Sequence
  hemagglutinin__InfluenzaA__AJK00218
auggagaaaauagugcuuuuucuugcaauagucagccuugucagaagugaucagauuugcauugguuaccaugcaaacaacucaacagagcagguugacacaauaauggaaaagaacgucacuguuacacaugcccaagacauacuggaaaagacacacaacgggaagcucugcgaucuagauggagugaagccuuugauuuuaagagauuguaguguagcuggauggcuucucggaaacccaaugugugacgaauuuaucaaugugccagaauggucuuacauaguggagaaggccaacccagccaaugaccucuguuacccagggaauuucaacgacuaugaagaacugaaacaccuauugagcagaauaaaucauuuugagaaaauucggaucauccccaaaaguucuuggcccgaucaugaagccucaucaggggugagcucagcauguccguaucagggaacgcccucuuuuuucaggaauauaguauggcuuaucaaaaagaacaauacauacccaacaauaaagagaagcuacaauaacaccagccaggaagaucuguugguacugugggggauucaucauucuagugaugcgacagaacagauaaagcucuaucaaaacccaaccaccuauguuuccguuggaacaucaacacuaaaccagagauugguaccaaaaauagcuacuagauccaaaguaaacgggcaaaguggaaggauggauuucuucuggacaauuuuaaaaucgaaugaugcaaucaacuucgaaaguaaugggaauuucauugcuccagaauaugcauacaaaauugucaagaaaggggacucagcaauuaugaaaagugaaguggaauaugguaacugcagcaccaagugucaaacuccgauaggggcgauaaacucuaguaugcccuuccacaauauacacccccucaccaucggggaaugccccaaauaugugaaaucaaacaaauuaguccuugcgacugggcucagaaauaguccucuaagagaaaggagaaggaaaagaggacuauuuggagcuauagcaggguuuauagagggaggauggcagggaaugguagaugguugguauggguaccaccauaguaaugagcaggggaguggauacgcugcagacaaagaauccacccaaaaggcaauagauggagucaccaauaaggucaacucuaucauugacaaaaugaacacucaguuugaggccguugggagggaauucaauaacuuagaaaggagaauagagaauuuaaacaagaaaauggaagacggauuccuagaugucuggacuuauaaugcugaacuucugguucucauggaaaaugagaggacucuagacuuccaugacucaaaugucaagaaccuuuacgacaagguccggcuacagcugagggauaaugcaaaggagcuggguaacgguugcuuugaguucuaucacaaaugugauaaugaauguauggaaaguguaagaaacggaacguaugacuacccgcaguauucagaagaagcaagauuaaaaagagaggaaauuaguggaguaaaauuggaaucaauaggaacuuaccaaauacugucaauuuauucaacagcugcgaguucucuagcgcuggcaaucaugguggcuggucuaucuuuguggaugugcuccaaugggucguuacaaugcagaauuugcauuuaa

SEQ ID NO: 43460 - RNA, 1704 nt, Artificial Sequence
  hemagglutinin__InfluenzaA__AJK00239
auggagaaaauagugcuucuucuugcaauagucagccuuguuagaagugaucagaucugcauugguuaccaugcaaacaacucgacagagcagguugacacaauaauggaaaagaacguuacuguuacacaugcccaagacauacuggaaaagacacacaacgggaagcucugcgaucuagauggagugaagccuuugauuuuaagagauuguaguguagcuggauggcuccucggaaacccaaugugugacgaauuuaucaaugugccagaauggucuuacauaguggagaaggccaacccagccaaugaccucuguuacccagggaauuucaacgacuaugaagaacugaaacaccuauugagcagaauaaaucauuuugagaaaauucagaucauucccaaaaguucuugguccgaucaugaagccucaucaggggugagcucagcauguccguaucagggaacgcccucuuuuuucaggaauguaguauggcuuaucaaaaagaacaauacauacccaacaauaaagagaagcuacaauaacaccagccaggaagaucuguugguacugugggggauucaccauucuaaugaugcgacagaacagaugaagcucuaucaaaacccaaccaccuauguuuccguuggaacaucaacacuaaaccagagauugguaccaaaaauagcuacuagauccaaaguaaacgggcaaaguggaaggauggauuucuucuggacaauuuuaaaaucgaaugaugcaaucaacuucgaaagcaaugggaauuucauugcuccagaauaugcauacaaaauugucaagaaaggggacucagcaauuaugaaaagugaaguggaauaugguaacugcagcaccaagugucaaacuccgauaggggcgauaaacucuaguaugccauuccacaauauacacccucucaccaucggggaaugccccaaauaugugaaaucaaacaaauuaguccuugcgacugggcucagaaauaguccucuaagagaaaggagaagaaaaagaggacuauuuggagcuauagcaggguuuauagagggaggauggcagggaaugguagaugguugguauggguaccaccauaguaaugagcaggggaguggguacgcugcagacaaagaauccacccaaaaggcaauagauggaguuaccaauaaggucaacucuaucauugacaaaaugaacacucaguuugaggccguuggaagggaauuuaauaacuuagaaaggagaauagagaauuuaaacaagaaaauggaagacggauuccuagaugucuggacuuauaaugcugaacuucugguucucauggaaaaugagaggacucuagacuuccaugacucaaaugucaagaaccuuuacgacaagguccgacuacagcugagggauaaugcaaaggagcuggguaacgguugcuucgaguucuaucacaaaugugauaaugaauguauggaaaguguaagaaacggaacguaugacuacccgcaguauucagaagaagcaagauuaaaaagagaggaaauuaguggaguaaaauuggaaucaauaggaacuuaccaaauacugucaauuuauucaacaguugcgaguucucuagcgcuggcaaucaugguggcuggucuaucuuuguggaugugcuccaaugggucguuacaaugcagaauuugcauuuaa

SEQ ID NO: 43461 - RNA, 1704 nt, Artificial Sequence
  hemagglutinin__InfluenzaA__AJS18468
auggagaaaauagugcuucuucuugcagugguuagccuuguuaaaagugaucagauuugcauugguuaccaugcaaacaacucgacagagcagguugacacgauaauggaaaaaaacgucacuguuacacaugcccaagacauacuggaaaagacacacaacgggaggcucugcgaucugaauggagugaaaccucugauuuuaaaggauuguaguguagcuggauggcuucuuggaaacccaaugugcgacgaguucaucagagugccggaauggucuuacauaguggagagggcuaacccagccaaugaccucuguuacccagggaaucucaaugacuaugaagaacugaaacaccuauugagcagaauaaaucauuuugagaagacucugaucauccccaagaguucuuggcccaaucaugaaacaucauuaggggugagugcagcauguccauaccagggagugcccuccuuuuucagaaaugugguauggcuuaccaagaagaacgaugcauacccaacaauaaagaugagcuacaauaauaccaauagggaagaucuuuugauacugugggggauucaucauuccaacaaugcagcagagcagacaaaucucuauaaaaacccaaccaccuauguuuccguugggacaucaacauuaaaccagagauuggugccaaaaauagcuacuagaucccaaguaaacgggcaacguggaagaauggauuucuucuggacaauuuuaaaaccgaaugaugcaauccacuucgagaguaauggaaauuuuauugcuccagaauaugcauacaaaauagucaagaaaggggacucaacaauuaugaaaagugaaauggaauauggccacugcaacaccaaaugucaaacuccaauaggggcgauaaacucuaguaugccauuccacaauauacacccucucaccaucggggagugccccaaauacgugaaaucaaacaaauuaguccuugcgacugggcucagaaauaguccucuaagagaaagaagaagaaaaagaggacuauuuggagcuauagcaggguucauagagggaggauggcaaggaaugguagaugguugguauggguaccaccauagcaaugaacaggggaguggguacgcugcagacagagaauccacccaaaaggcaauagauggaguuaccaauaaggucaacucgauaauugacaaaaugaacacucaauuugaggccguuggaagggaguuuaauaacuuagaacggagaauagagaauuuaaauaagaaaauggaagacggauuccuagaugucuggacuuacaaugcugaacuuuuaguucucauggaaaaugagagaacucuagauuuccaugauucaaaugucaagaaccuuuaugacaaaguccgacuacagcuuagggauaaugcaaaggagcuggguaaugguuguuucgaguucuaucacaaaugugauaaugaauguauggaaaguguaagaaaugggacguaugacuacccccaguauucagaagaagcaagauuaaaaagggaagaaauaagcggagugaaauuggaaucaauaggaacuuaccaaauacugucaauuuauucaacaguggcgaguucccuaacacuggcaaucauuguggcuggucuaucuuuauggaugugcuccaaugggucguuacaaugcagaauuugcauuuaa

SEQ ID NO: 43462 - RNA, 1704 nt, Artificial Sequence
  hemagglutinin__InfluenzaA__AJS18479
auggagaaaauagugcuucuucuugcagugguuagccuuguuaaaagugaucagauuugcauugguuaccaugcaaacaacucgacagagcagguugacacgauaauggaaaaaaacgucacuguuacacaugcccaagacauacuggaaaagacacacaacgggaggcucugcgaucugaauggagugaaaccucugauuuuaaaggauuguaguguagcuggauggcuucuuggaaacccaaugugcgacgaguucaucagagugccggaauggucuuacauaguggagagggcuaacccagccaaugaccucuguuacccagggaaccucaaugacuaugaagaacugaaacaccuauugagcagaauaaaucauuuugagaagacucugaucauccccaagaguucuuggcccaaucaugaaacaucauuaggggugagcgcagcauguccauaccagggaaugcccuccuuuuucagaaaugugguauggcuuaccaagaagaacgauacauacccaacaauaaagaugagcuacaauaauaccaauagggaagaucuuuugauacuaugggggauucaucauuccaacaaugcagcagagcagacaaaucucuauaaaaauccaaccaccuauguuuccguugggacagcaacauuaaaccagagauuggugccaaaaauagcuacuagaucccaaguaaacgggcaacguggaagaauggauuucuucuggacaauuuuaaaaccgaaugaugcaauccacuucgagaguaauggaaauuuuauugcuccagaauaugcauacaaaauugucaagaaaggggacucaacaauuaugaaaagugaaauggaauauggccacugcaacaccaaaugucaaacuccaauaggggcgauaaacucuaguaugccauuccacaauauacacccucucacuaucggggagugccccaaauacgugaaaucaaacaaauuaguccuugcgacugggcucagaaauaguccucuaagagaaagaagaagaaaaagaggacuauuuggagcuauagcaggguuuauagagggaggauggcaaggaaugguagaugguugguauggguaccaccauagcaaugaacaggggaguggguacgcugcagacagagaauccacccaaaaggcaauagauggaguuaccaauaaggucaacucgauaauugacaaaaugaacacucaauuugaggccguuggaagggaguuuaauaacuuagaacggagaauagagaacuuaaauaagaaaauggaagacggauuccuagaugucuggacuuauaaugcugaacuuuuaguucucauggaaaaugagagaacucuagauuuccaugacucaaaugucaagaaccuuuaugacaaaguccgacuacagcuuagggauaaugcaaaggagcuggguaaugguuguuucgaguucuaucacaaaugugauaaugaauguauggaaaguguaagaaaugggacguaugacuacccccaguauucagaagaagcaagauuaaaaagggaagaaauaagcggagugaaauuggaaucaauaggaacuuaccaaauacugucaauuuauucaacaguggcgaguucccuagcacuggcaaucauuguggcuggucuaucuuuauggaugugcuccaaugggucguuacaaugcagaauuugcauuuaa

SEQ ID NO: 43463 - RNA, 1704 nt, Artificial Sequence
  hemagglutinin__InfluenzaA__AJY79339
auggagaaaauagugcuucuucuugcaauagucaguauuguuaaaagugaucagauuugcauugguuaccaugcaaacaacucgacagagcagguugacacaauaauggaaaagaacgucacuguuacacacgcccaagacauacuggaaaagacacacaacgggaaacucugcaaucuagauggagugaagccucucauuuuaagagauuguaguguagcuggauggcuccucgggaacccaaugugcgaugaauuccucaaugugccggaauggucuuacauaguggagaaaaucaauccagccaaugaccucuguuauccagggaauuuaaacgacuaugaagaacugaaacaucuauugagcagaauaaaccauuuugagaaaauucagaucauucccaaagauucuuggucagaucaugaagccucaggagugagcucagcaugcccauaccaaggaagauccuccuuuuuuagaaauguuguauggcuuaccaaaaagaacgaugcauacccaacaauaaagaaaaguuacaauaauacuaaccaagaagaucuuuugguacuaugggggauucaccauccaaaugaugcugcagagcagacaaggcuuuaucaaaacccaacuaccuauaucuccguugggacaucaacacuaaaccagagauugguacccaaaauagcuacuagaucuaagguaaacgggcaaaguggaaggauggaguucuuuuggacaauuuuaaaaucgaaugaugcaauaaacuuugagaguaauggaaauuucauugcuccagaaaaugcauacaaaauugucaagaaaggagauucaacaauuaugaaaagugaguuggaauauagcaacugcaacaccaagugucagacuccaauaggggcgauaaacuccaguaugccauuccacaacauccacccucucaccaucggggaaugccccaaauaugugaaaucaaacagauuaguccuugcuacugggcucaggaauagcccucaaggggagaaaagaagaaaaaagagaggacuauucggagccauagcaggcuuuauagagggaggauggcagggaaugguagaugguugguauggguaccaccauagcaacgagcaggggaguggguacgcugcagacaaagaauccacucaaagggcuauagauggagucaccaauaaggucaauucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaucuuuaugacaagguccgacuacagcuuagggauaaugcaaaggagcuugguaacgguuguuucgaguucuaucacagaugugauaaugaauguauggaaaguguaagaaacggaacguaugacuacccucaauauucagaagaagcaagauuaaaaagagaggaaauaaguggaguaaaauuggagucaauaggaacuuaccaaauacugucaauuuauucaacaguggcgagcucccuagcacuggcaaucaugguggcuggucuaucuuuauggaugugcuccaauggaucgcuacaaugcagaauuugcauuuaa

SEQ ID NO: 43464 - RNA, 1704 nt, Artificial Sequence
  hemagglutinin__InfluenzaA__AJY79341
auggagaaaauagugcuucuucuugcaauagucaguauuguuaaaagugaucagauuugcauugguuaccaugcaaacaacucgacagagcagguugacacaauaauggaaaagaacgucacuguuacacacgcccaagacauacuggaaaagacacacaacgggaaacucugcaaucuagauggagugaagccucucauuuuaagagauuguaguguagcuggauggcuccucgggaacccaaugugcgaugaauuccucaaugugccggaauggucuuacauaguggagaaaaucaauccagccaaugaccucuguuauccagggaauuucaacgacuaugaagaacugaaacaccuauugagcagaauaaaccauuuugagaaaauucagaucauucccaaagauuccuggucagaucaugaaaccucaggagugagcucagcaugcccauaccaaggaagauccuccuuuuuuagaaauguuguguggcuuaccaaaaagaacgaugcauacccaacaauaaagaaaaguuacaauaauacuaaccaagaagaucuuuugguacuaugggggauucaccauccaaaugaugcugcagagcagacaaggcuuuaucaaaacccaacuaccuacaucuccguugggacaucaacacuaaaccagagauugguacccaaaauagcuaccagaucuaagguaaacgggcaaaauggaaggauggaguucuuuuggacaauuuuaaaaucgaaugaugcaauaaacuuugagaguaauggaaauuucauugcuccagaaaaugcauacaaaauugucaagaaaggagauucaacaauuaugagaagugaguuggaauauaguaacugcaacaccaagugucagacuccaauaggggcgauaaacuccaguaugccauuccacaacauucacccucucaccaucggggaaugccccaaauaugugaaaucaaacagauuaguccuugcuacugggcucaggaauagcccucaaggagagaaaagaagaaaaaagagaggacuauucggagccauagcaggcuuuauagagggaggauggcagggaaugguagaugguugguauggguaccaucauagcaacgagcaggggaguggguacgcugcagacaaagaauccacucaaagggcuauagauggagucaccaauaaggucaauucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaucuuuaugacaagguccgacuacagcuuagggauaaugcaaaggagcuugguaacgguuguuucgaguucuaucacagaugugauaaugaauguauggaaaguguaagaaacggaacguaugacuacccucaauauucagaagaagcaagauuaaaaagagaggaaauaaguggaguaaaauuggagucaauaggaacuuaccaaauacugucaauuuauucaacaguggcgagcucccuagcacuggcaaucaugguggcuggucuaucuuuauggaugugcuccaauggaucgcuacaaugcagaauuugcauuuaa

SEQ ID NO: 43465 - RNA, 1704 nt, Artificial Sequence
  hemagglutinin__InfluenzaA__AJY79342
auggagaaaauagugcuucuucuugcaauagucaguauugucaaaagugaucagauuugcauugguuaccaugcaaacaacucgacagagcagguugacacaauaauggaaaagaacgucacuguuacacacgcccaagacauacuggaaaagacacacaacgggaaacucugcaaucuagauggagugaagccucucauuuuaagagauuguaguguagcuggauggcuccucgggaacccaaugugcgaugaauuccucaaugugccggaauggucuuacauaguggagaaaaucaauccagccaaugaccucuguuauccagggaauuucaacgacuaugaagaacugaaacaccuauugagcagaauaaaccauuuugagaaaauucagaucauucccaaagauucuuggucagaucaugaagccucaggagugagcucagcaugcccauaccaaggaagauccuccuuuuuuagaaauguuguauggcuuaccaaaaagaacgaugcauacccaacaauaaagaaaaguuacaauaauacuaaccaagaagaucuuuugguacuaugggggauucaccauccaaaugaugcugcagagcagacaaggcuuuaucaaaacccaacuaccuauaucuccguugggacaucaacacuaaaccagagauugguacccaaaauagcuacuagaucuaagguaaacgggcaaaguggaaggauggaguucuuuuggacaauuuuaaaaucgaaugaugcaauaaacuuugagaguaauggaaauuucauugcuccagaaaaugcauacaaaauugucaagaaaggagauucaacaauuaugaaaagugaguuagaauauaguaacugcaacaccaagugucagacuccaauaggggcgauaaacuccaguaugccauuccacaacauccacccucucaccaucggggaaugccccaaauauguaaaaucaaacagauuaguccuugcuacugggcucaggaauagcccucaaggagagaaaagaagaaaaaagagaggacuauucggagccauagcaggcuuuauagagggaggauggcagggaaugguagaugguugguauggguaccaccauagcaacgagcaggggaguggguacgcugcagacaaagaauccacucaaagggcuauagauggagucaccaauaaggucaauucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaucuuuaugacaagguccgacuacagcuuagggauaaugcaaaggagcuugguaacgguuguuucgaguucuaucacagaugugauaaugaauguauggaaaguguaagaaacggaacguaugacuacccucaauauucagaagaagcaagauuaaaaagagaggaaauaaguggaguaaaauuggagucaauaggaacuuaccaaauacugucaauuuauucaacaguggcgagcucccuagcacuggcaaucaugguggcuggucuaucuuuauggaugugcuccaauggaucgcuacaaugcagaauuugcauuuaa

SEQ ID NO: 43466 - RNA, 1704 nt, Artificial Sequence
  hemagglutinin__InfluenzaA__AJY79343
auggagaaaauagugcuucuucuugcaauagucaguauuguuaaaagugaucagaucugcauugguuaccaugcaaacaacucgacagagcagguugacacaauaauggaaaagaaugucacuguuacacacgcccaagacauacuggaaaagacacacaacgggaaacucugcaaucuagauggagugaagccucucauuuugagagauuguaguguagcuggauggcuccucgggaacccaaugugcgaugaauuccucaaugugccggaauggucuuacauaguggagaaaaucaauccagccaaugaccucuguuauccagggaauuucaacgacuaugaagaacugaaacaccuauugagcagaauaaaccauuuugagaaaauucagaucauucccaaagauucuuggucagaucaugaagccucgggagugagcucagcaugcccauaccaaggaagauccuccuuuuuuagaaauguuguauggcuuaccaaaaagaacgaugcauacccaacaauaaagaaaaguuacaauaauacuaaccaagaagaucuuuugguacuaugggggauucaccauccaaaugaugcugcagagcagacaaggcuuuaucaaaacccaacuaccuauaucuccguugggacaucaacacuaaaccagagauugguacccaaaauagcuacuagaucuaagguaaacgggcaaaguggaaggauggaguucuuuuggacaauuuuaaaaucgaaugaugcaauaaacuuugagaguaauggaaauuucauugcuccagaaaaugcauacaaaauugucaagaaaggagauucaacaauuaugaaaagugaguuggaauauaguaacugcaacaccaagugucagacuccaauaggggcgauaaacuccaguaugccauuccacaacauccacccucucaccaucggggaaugccccaaauaugugaaaucaaacagauuaguccuugcuacugggcucaggaauagcccucaaggagagaaaagaagaaaaaagagaggacuauucggagccauagcaggcuuuauagagggaggauggcagggaaugguagaugguugguauggguaccaccauagcaacgagcaggggaguggguacgcugcagacaaagaauccacucaaagggcuauagauggagucaccaauaaggucaauucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggagaaugagagaacucuagacuuucaugacucaaaugucaagaaucuuuaugacaagguccgacuacagcuuagggauaaugcaaaggagcuugguaacgguuguuucgaguucuaucacagaugugaugaugaauguauggaaaguguaagaaacggaacguaugacuacccucaauauucagaagaagcaagauuaaaaagagaggaaauaaguggaguaaaauuggagucaauaggaacuuaccaaauacugucaauuuauucaacaguggcgagcucccuagcacuggcaaucaugguggcuggucuaucuuuauggaugugcuccaauggaucgcuacaaugcagaauuugcauuuaa

SEQ ID NO: 43467 - RNA, 1704 nt, Artificial Sequence
  hemagglutinin__InfluenzaA__AJY79345
auggagaaaauagugcuucuucuugcaauagucaguauugucaaaagugaucagauuugcauugguuaccaugcaaacaacucgacagagcagguugacacaauaauggaaaagaacgucacuguuacacgcgcccaagacauacuggaaaagacacacaacgggaaacucugcaaucuagauggagugaagccucucauuuuaagagauuguaguguagcuggauggcuccucgggaacccaaugugcgaugaauuccucaaugugccggaauggucuuacauaguggagaaaaucaauccagccaaugaccucuguuauccagggaauuucaacgacuaugaagaacugaaacaccuauugagcagaauaaaccauuuugagaaaauucagaucauucccaaagauucuuggucagaucaugaagccucaggagugagcucagcaugcccauaccaaggaagauccuccuuuuuuagaaauguuguauggcuuaccaaaaagaacgaugcauacccaacaauaaagaaaaguuacaauaauacuaaccaagaagaucuuuugguacuaugggggauucaccauccaaaugaugcugcagagcagacaaggcuuuaucaaaacccaacuaccuauaucuccguugggacaucaacacuaaaccagagauugguacccaaaauagcuacuagaucuaagguaaacgggcaaaguggaaggauggaguucuuuuggacaauuuuaaaaucgaaugaugcaauaaacuuugagaguaauggaaauuucauugcuccagaaaaugcauacaaaauugucaagaaaggagauucaacaauuaugaaaagugaguuggaauauaguaacugcaacaccaagugucagacuccaauaggggcgauaaacuccaguaugccauuccacaacauccacccucucaccaucggggaaugccccaaauaugugaaaucaaacagauuaguccuugcuacugggcucaggaauagcccucaaggagagaaaagaagaaaaaagagaggacuauucggagccauagcaggcuuuauagagggaggauggcagggaaugguagaugguugguauggguaccaccauagcaacgagcaggggaguggguacgcugcagacaaagaauccacucaaagggcuauagauggagucaccaauaaggucaauucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaucuuuaugacaagguccgacuacagcuuagggauaaugcaaaggagcuugguaacgguuguuucgaguucuaucacagaugugauaaugaauguauggaaaguguaagaaacggaacguaugacuauccucaauauucagaagaagcaagauuaaaaagagaggaaauaaguggaguaaaauuggagucaauaggaacuuaccaaauacugucaauuuauucaacaguggcgagcucccuagcacuggcaaucaugguggcuggucuaucuuuauggaugugcuccaauggaucgcuacaaugcagaauuugcauuuaa

SEQ ID NO: 43468 - RNA, 1701 nt, Artificial Sequence
  hemagglutinin__InfluenzaA__AKA54643
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauugguaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43469 - RNA, 1701 nt, Artificial Sequence
  hemagglutinin__InfluenzaA__AKA54650
augaagacuaucauugcuuugagcuacauucuaugucugguuuucacucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuauuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43470 - RNA, 1701 nt, Artificial Sequence
  hemagglutinin__InfluenzaA__AKA54651
augaagacuaucauugcuuuuagcugcaucuuaugucagaucuccgcucaaaaacuccccggaagugacaacagcauggcaacgcugugccuggggcaucacgcaguaccaaacggaacguuagugaaaacaauaacagaugaccaaauugaagugacuaaugcuacugagcugguccagaguaccucaaaaggugaaauaugcaguaguccucaccaaauccuugauggaaaaaauuguacacugauagaugcucuauugggagacccucauugugaugacuuccaaaacaagaaaugggaccuuuuuguugaacgaagcacagcuuacagcaacuguuacccuuauuaugugccggauuaugccucccuuaggucacuaguugccucauccggcacccuggaauuuacucaagaaagcuucaauuggacugggguugcucaagacggagcaagcuauucuugcagaagggaaucugaaaacaguuucuuuaguagauugaauugguuauauaguuugaauuacaaauauccagcgcugaacguaacuaugccaaacaaugacaaauuugacaaauuguacauuugggggguacaccacccggguacggacaaggaccaaaccagucuauauauucaagcaucagggagaguuacagucuccaccaaauggagccaacaaacuguaaucccgaauaucgggucuagacccuggauaaggggugucuccagcauaauaagcaucuauuggacaauaguaaaaccgggagacauacuuuugauuaacagcacagggaaucuaauugccccucgggguuacuucaaaauacaaagugggaaaagcucaauaaugaggucagaugcacacauuggcaacugcaacucugaaugcauuaccccaaauggaagcauucccaacgacaaaccuuuucaaaauguaaacagaauaacauauggggccugucccagauauguuaagcaaaacacucugaaauuagcaacaggaaugcggaauguaccagagaaacaaacuagaggcauauucggcgcaaucgcagguuucauagaaaaugguugggaagggaugguggacgguugguaugguuucaggcaucaaaacucugaaggcacagggcaagcagcagaucuuaaaagcacucaagcggcaaucaaccaaaucaccgggaaacuaaauagaguaaucaagaagacgaaugaaaaauuccaucagaucgaaaaagaauucucagaaguagaagggagaauucaggaccuagagagauacguugaagacacuaaaauagaccucuggucuuacaacgcggagcuucuuguugcccuggagaaccaacauacaauugauuuaacugacucagaaaugaacaaacuguucgaaaggacaaggaagcaacugcgggaaaaugcugaggacaugggcaauggaugcuuuaaaauauaucacaaaugugacaaugccugcauaggaucaaucagaaauggaacuuaugaccaugauguauacagagacgaagcaguaaacaaucgguuccagaucaaagguguucagcugaaguuaggauacaaagauuggauccuauggauuuccuuugccauaucaugcuuuuugcuuugugcuguucugcuaggauucauuaugugggcaugccaaaaaggcaacauuaggugcaacauuugcauuuga

SEQ ID NO: 43471 - RNA, 1701 nt, Artificial Sequence
  hemagglutinin__InfluenzaA__AKA59351
augaaggcaauacuaguaauucugcuauauacauuugcagccgcaaaugcagacacaauauguauagguuaucaugcgaacaauucaacagacacuguggacacaguacuagaaaagaauguaacaguaacacacucuguugaccuucuagaagacaagcauaaugggagacuaugcaaacuaagagggguagcuccauuacauuuggguaaauguaacauugcuggcuggauccugggaaauccagagugugaaucacucuccacagcaagcucaugguccuacauuguggaaacauccaguucagacaauggaacguguuacccaggagauuucaucgauuaugaggagcuaagagagcaauugagcucagugucaucauuugaaagguuugagauauuccccaagacaaguucauggccuaaucaugaaucgaacaaaggugugacggcagcauguccucaagcuggagcaaaaaguuucuacaaaaauuuaauauggcuaguuaaaaaagaaaauucauacccaaagcucagcaaauccuacauuaaugauaaagggaaagaaguccucgugcuguggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaaggaagaaugaacuauuacuggacacuaguagagccgggagacaaaauaacauucgaagcaacuggaaaucuagugguaccgagauaugcauucgcaauggaaagaaaugcuggaucugguaucaucauuucagauacaccaguccacgauugcaauacaacuugucagacacccaagggugcuauaaacaccagccuaccauuucagaauauacauccgaucacaauugggaaauguccaaaauauguaaaaagcacaaaauugagacuggccacaggauugaggaaugucccgucuauucagucuagaggccuauuuggggccauugccggcuucauugaagggggguggacagggaugguagauggaugguacgguuaucaccaucaaaaugagcaggggucaggauaugcagccgaccugaagagcacacagaaugccauugacgagauuacuaacaagguaaauucuguuauugaaaagaugaauacacaguucacagcaguagguaaagaauucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaagaaauuggaaacggcugcuuugaauuuuaccacaaaugcgauaacacgugcauggaaagugucaagaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43472 - RNA, 1701 nt, Artificial Sequence
  hemagglutinin__InfluenzaA__AKA59353
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuugggugaauguaacauugcuggcuggauccugggaaauccagagugugaaucacucucaacagcaagcucaugguccuacauuguggaaacaccuaguucaaacaauggaacguguuacccaggagauuucaucgauuaugaggagcuaagagagcaauugagcucagugucaucauuugaaagguuugagauauuccccaauacaaguucauggcccaaucaugacucgagcaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccuucuacuagugcugaccaacaaaaacucuaucagaaugaagaugcauauguuuuuguggggacaucaagauacagcaagaaauucaagccggaaauagcaauaagacccaaagugagggaucaagaagggagaaugaacuauuacuggacacuaguagagccgggagacaaaauaacauucgaagcaacuggaaauauagugguaccgagauaugcauucgcaauggaaagaaacgcugggucugguauuaucauuucagauacaccaguccacaauugcaauacaacuugucagacacccaagggugcuauaaacaccagccucccauuccagaauguacauccgaucacaauuggaaaauguccaaaauauguaaaaagcacaaaguugagacuggccacaggauugaggaaugucccgucuauucaaucuagaggccuauuuggggccauugccgguuucauugaagggggauggacagggaugguagauggaugguacgguuaucaccaucaaaaugagcaggggucaggauuugcagccgaccugaagagcacacagaaugccauugacgggauuacuaacaaaguaaauucuguuauugaaaagaugaauacacaguucacagcaguagguaaagaguucaaccaccuggaaaaaagaauagagaauuuaaauagaaagauugaugaugguuuccuagacauuuggacuuacaaugccgaacuguugauucuauuggaaaaugaaagaacuuuggacuaccacgauucaaaugugaggaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggggugaagcuggaaucaacaaggauuuaccagauuuuggcgaucuauucaacugucgccaguucauugguacugauagucucccugggggcaaucaguuucuggaugugcucuaaugggucgcuacaguguagaauauguauuuaa

SEQ ID NO: 43473 - RNA, 1701 nt, Artificial Sequence
  hemagglutinin__InfluenzaA__AKA59355
augaaggcaauacuaguaguucugcuauauacauuugcaaccgcaaaugcagacacauuauguauaggguaucaugcgaacaauucaacagacacuguagacacaguacuagaaaaaaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacgucuaguucagacaauggaacguguuacccaggagauuucaucgauuaugaggagcuaagagagcaauugagcucaguaucaucauuugaaagguuugagauauuccccaagacaaguucauggcccaaucaugauucgaacaaaggaguaacggcagcauguccucaugcuggagcaagaagcuucuacaaaaauuuaauauggcuaguuaaaaaaggaaauucauacccaaagcucaaccaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaagccagaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauuguaauacaacuugucagacacccaagggugcuauaaacacaagccucccauuucagaauauacauccgaucacaauuggaaaauguccaaaguauguaaaaaguacaaaauugagacuggccacaggauugaggaaugucccgucuauucaaucuagaggccuauuuggggccaucgccgguuucauugaaggaggguggacaggaaugguggauggaugguacgguuaucaccaucaaaaugagcaagggucaggauaugcagccgaccugaagagcacacagaaugccauugacgagauuacuaacaaaguaaauuugguuauugaaaagaugaauacacaguucacagcagucgguaaagaguucagccaccuggaaaaaagaauagagaauuuaaauaaaaaaguugaugaugguuuccuggacauuuggacuuacaaugccgaacuguugguucuauuggaaaaugaaagaacuuuggacuaccacgauucaaauguaaagaacuuauaugaaaagauaagaagccaguuaaaaaacaaugccaaggaaauuggaaacggcugcuuugaauuuuaccacaagugcgauaacacgugcauggaaagugucaaaaaugggacuuaugauuacccaaaauacucagaggaagcaaaauuaaacagagaagaaauagaugggguaaagcuggaaucaacaaggguuuaccagauuuuggcgaucuauucaacugucgccaguucauugguacugguagucucccugggggcaaucaguuucuggaugugcucuaaugggucucuacaguguagaauauguauuuaa

SEQ ID NO: 43474 - RNA, 1701 nt, Artificial Sequence
  hemagglutinin__InfluenzaA__AKE37137
augaaggcaagacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauagcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcacauccuacauuaaugauaaagggaaagaaguccuugugcuauggggcauucaccauccaucuacuagugcugaccaacaaagucucuaucagaaugcagaugcauaugcuuuuguggggacaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaucaguccacgauugcaauacaacuugucagacacccaagggugcuauaaacaccagccucccauuucagaauguacauccgaucacaauuggaaaauguccaaaauauguaaaaagcacaaaauugagacuggccacaggauugaggaaugucccgucuauucaaucucgaggccuauuuggggccauugccgguuucauugaagggggguggacagggaugguagauggaugguacgguuaucaucaucaaaaugagcaggggucaggauaugcagccgaccugaagagcacacagaaugccuuugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaguacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 43475 - RNA, 1701 nt, Artificial Sequence
  hemagglutinin__InfluenzaA__AKS48035
auggagaaaauggugcuucuucuugcagugguuagccuuguuaaaagugaucagauuugcauugguuaccaugcaaacaacucgacagagcagguugacacgauaauggaaaagaacgucacuguuacacaugcccaagacauacuggaaaagacacacaacgggagacucugcgaucugaauggagugaaaccucugauuuuaaaggauuguaguguagcuggauggcuccuuggaaacccaaugugugacgaguucaucagagugccggaauggucuuacauaguggagagggcuaacccagccaaugaccucuguuauccagggaaccucaaugacuaugaggaacugaaacaccuauugagcagaauaaaucauuuugagaagacucugaucauccccaagaguucuuggcccaaucauacaucaucaggggugagcgcagcauguccauaccagggaaugcccuccuuuuucagaaaugugguauggcuuaccaaaaagaacgaugcauacccaacaauaaagaugagcuacaauaauaccuauagggaagaucuuuugauacugugggggauucaucauuccaacaaugcagcagaacagacaaaucucuauaaaaacccaaccaccuauguuuccguugggacaucaacauuaaaccagagauuggagccaaaaauagcuacuagaucccaaguaaacgggcaacguggaagaauggauuucuucuggaccauuuuaaaaccgaaugaugcaauccacuucgagaguaauggaaauuuuauugcuccagaauaugcauacaaaauugucaagaaaggggacucaacaauuaugaaaagugaaauggaauaugggcacugcaacaccaaaugucaaacuccaauaggggcgauaaacucuaguaugccauuccacaauauacacccucucacuaucggggagugccccaaauacgugaaaucgaacaaauuaguccuugcgacugggcucagaaauaguccucuaagagaaagaagaagaaaaagaggacuauuuggagcuauagcaggguuuauagagggaggauggcaaggaaugguagaugguugguauggguaccaccauagcaaugaacaggggaguggguacgcugcagacagagaauccacccaaaaggcaauagauggaguuaccaauaaggucaacucgauaauagacaaaaugaacacucaauuugaggccguuggaagagaauuuaauaacuuagaacggagaauagagaauuuaaauaagaaaauggaagacggauucuuagaugucuggacuuauaaugcugaacuuuuaguucucauggaaaaugagagaacucuagauuuccaugauucaaaugucaagaaccuuuaugacaagguccgacuacagcuuagggauaaugcaaaggagcuggguaaugguuguuucgaguucuaucacaaaugugauaaugaauguauggaaaguguaagaaaugggacguaugacuacccccaguauucagaagaagcaagauuaaaaagggaagaaauaagcggagugaaauuggaaucaauaggaacuuaccaaauacugucaauuuauucaacaguggcgaguucccuagcacuggcaaucauuguggcuggucuaucuuuauggaugugcuccaaugggucguuacaaugcagaauuugcauuuaa

SEQ ID NO: 43476 - RNA, 1701 nt, Artificial Sequence
  hemagglutinin__InfluenzaA__ALA08472
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacguuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43477 - RNA, 1701 nt, Artificial Sequence
  hemagglutinin__InfluenzaA__ALA08475
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugagcaauuugacaaauuguacauuugggggguucaccacccggguacggacaaggaccaaaucuuccuguaugcucaaucaucaggaagaauaacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugagugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaauuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43478 - RNA, 1701 nt, Artificial Sequence
  hemagglutinin__InfluenzaA__ALA08478
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaagucacuaaugcuacugagcugguucagaauuccucaauaggugaaauaugcgacaguccucaucagauccuugauggaaaaaacugcacucuaauagaugcucuauugggagacccucagugugauggcuuucaaaauaagagaugggaccuuuuuguugaacgaagcaaagccuacagcaacuguuacccuuaugaugugccggauuaugccucccuuaggucacuaguugccucauccggcacacuggaguuuaacgaugaaagcuucaauugggcuggagucacucaaaacggaacaaguucugcuugcauaaggggaucuaauaguaguuucuuuaguagauugaauugguugacccacucaaacuucaaauacccagcauugaacgugacuaugccaaacaaugaacaauuugacaaauuguacauuugggggguucaccacccggguacagacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcggcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43479 - RNA, 1701 nt, Artificial Sequence
  hemagglutinin__InfluenzaA__ALA08479
augaagacuaucauugcuuugagcuacauucuaugucugguuuucgcucaaaaacuuccuggaaaugacaauagcacggcaacgcugugccuugggcaccaugcaguaccaaauggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacggagcaaagccuacagcaacuguuacccuuaugaugugccggauuaugccucccuuaggucacuaguugccucauccggcacacuggaguuuaacaaugaaagcuucaauugggcuggagucacccaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucgucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaccuaauugcuccuagggguuacuucaaaauacgaagugggaaaagcucaauaaugagaucagaugcacccauuggcaaaugcaagucagaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaaacaacugagggaaaaugcugaggauaugggcaaugguuguuucaaaauauaccacaaaugugacaaugccugcauaggaucaaucagaaauggaacuuaugaccacgauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43480 - RNA, 1701 nt, Artificial Sequence
  hemagglutinin__InfluenzaA__ALA08481
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaucaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagguauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauauggguaaugguuguuucaaaauauaccacaaaugugacaaugccugcauagggucaaucagaaauggaacuuaugaccaugauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43481 - RNA, 1701 nt, Artificial Sequence
  hemagglutinin__InfluenzaA__ALA08482
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaucaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagguauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauauggguaaugguuguuucaaaauauaccacaaaugugacaaugccugcauagggucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43482 - RNA, 1701 nt, Artificial Sequence
  hemagglutinin__InfluenzaA__ALA08483
augaagacuaucauuggcuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggggaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaagggggucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaucaucagggagaaucacaguaucuaccaaaagaagccaacaagcuguaaucccgaauaucggauccagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43483 - RNA, 1701 nt, Artificial Sequence
  hemagglutinin__InfluenzaA__ALA08484
augaagacuaucauugcuuugagcuacauucuaugucugguuuucgcucaaaaaauuccuggaaaugacaauagcacggcaacgcugugccuugggcaccaugcaguaccaaacggaacgauagugaaaacaauaacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaauaucuaccaaaagaagccaacaagcuguaaucccaaauaucggaucuagacccagaauaagggauaucccuagcagaauaagcaucuauuggacaauaguaaaaccgggggacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43484 - RNA, 1701 nt, Artificial Sequence
  hemagglutinin__InfluenzaA__ALA08488
augaagacuauuauugcuuugagcuacauucuaugucugguuuucgcucaaaaaauuccuggaaauggcaauagcacggcaacgcugugccuugggcaccaugcaguaccaaacggaacgauagugaaaacaaucacgaaugaccgaauugaaguuacuaaugcuacugagcuaguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaacuggacuggagucacucaaaacggaacaaguucugcuugcauaaggagaucuaguaguaguuucuuuaguagauuaaauugguugacccacuuaaacuacacauacccagcauugaacguaacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucggaaaugaacaaacuguuugaaaaaacaaaaaagcaacugagggaaaaugcugaagauaugggcaaugguuguuucaaaauauaccacaaaugugacaaugccugcauaggaucaauaagaaauggaacuuaugaccacaauguguacagggaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43485 - RNA, 1701 nt, Artificial Sequence
  hemagglutinin__InfluenzaA__ALA08490
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguucaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccgaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaacggaacuuaugaccacaauguguacagggaugaagcauuaaacaaccgguuccagaucaagggaauugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43486 - RNA, 1701 nt, Artificial Sequence
  hemagglutinin__InfluenzaA__ALA08491
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacaugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugccccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgaaaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43487 - RNA, 1701 nt, Artificial Sequence
  hemagglutinin__InfluenzaA__ALA08492
augaagacuaucauugcuuugagcuacauucuaugucugguuuucgcucaaaaaauuccuggaaaugacaauagcacggcaacacugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugcaucauccggcacacuggaguucaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaacggaacuuaugaccacaauguguacagggaugaagcauuaaacaaccgguuccagaucaagggaauugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43488 - RNA, 1701 nt, Artificial Sequence
  hemagglutinin__InfluenzaA__ALA08493
augaagaccaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguucaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaggucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaacggaacuuaugaccacaauguguacagggaugaagcauuaaacaaccgguuccagaucaagggaauugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43489 - RNA, 1701 nt, Artificial Sequence
  hemagglutinin__InfluenzaA__ALA08494
augaagacuaucauugccuugagcuacauucuaugucugguuuucgcucaaaaaauuccuggaaaugauaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43490 - RNA, 1701 nt, Artificial Sequence
  hemagglutinin__InfluenzaA__ALA08495
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcacugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaaacugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43491 - RNA, 1701 nt, Artificial Sequence
  hemagglutinin__InfluenzaA__ALA08496
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43492 - RNA, 1701 nt, Artificial Sequence
  hemagglutinin__InfluenzaA__ALA08497
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaaaaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43493 - RNA, 1701 nt, Artificial Sequence; identical to SEQ ID NO: 43477
  hemagglutinin__InfluenzaA__ALA08498

SEQ ID NO: 43494 - RNA, 1701 nt, Artificial Sequence
  hemagglutinin__InfluenzaA__ALA08499
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaguagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43495 - RNA, 1701 nt, Artificial Sequence; identical to SEQ ID NO: 43478
  hemagglutinin__InfluenzaA__ALA08501

SEQ ID NO: 43496 - RNA, 1701 nt, Artificial Sequence
  hemagglutinin__InfluenzaA__ALA08502
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaguagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43497 - RNA, 1701 nt, Artificial Sequence; identical to SEQ ID NO: 43496
  hemagglutinin__InfluenzaA__ALA08503

SEQ ID NO: 43498 - RNA, 1701 nt, Artificial Sequence
  hemagglutinin__InfluenzaA__ALA08504
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43499 - RNA, 1701 nt, Artificial Sequence; identical to SEQ ID NO: 43498
  hemagglutinin__InfluenzaA__ALA08505

SEQ ID NO: 43500 - RNA, 1701 nt, Artificial Sequence
  hemagglutinin__InfluenzaA__ALA08506
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacagaaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43501 - RNA, 1701 nt, Artificial Sequence; identical to SEQ ID NO: 43498
  hemagglutinin__InfluenzaA__ALA08507

SEQ ID NO: 43502 - RNA, 1701 nt, Artificial Sequence
  hemagglutinin__InfluenzaA__ALA08508
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaagggguucuaauaguaguuucuuuaguagauuaaauugguugacccacucaaacuucaaauacccagcauugaacgugaccaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcugcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43503 - RNA, 1701 nt, Artificial Sequence
  hemagglutinin__InfluenzaA__ALA08509
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucgauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucuuaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43504 - RNA, 1701 nt, Artificial Sequence; identical to SEQ ID NO: 43498
  hemagglutinin__InfluenzaA__ALA08510

SEQ ID NO: 43505 - RNA, 1701 nt, Artificial Sequence
  hemagglutinin__InfluenzaA__ALA08511
augaagacuaucauugccuugagcuacauucuaugucugguuuucgcucaaaaaauuccuggaaaugacaauagcacggcaacguugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucuucuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccgaguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43506 - RNA, 1701 nt, Artificial Sequence; identical to SEQ ID NO: 43498
  hemagglutinin__InfluenzaA__ALA08512

SEQ ID NO: 43507 - RNA, 1701 nt, Artificial Sequence; identical to SEQ ID NO: 43498
  hemagglutinin__InfluenzaA__ALA08514

SEQ ID NO: 43508 - RNA, 1701 nt, Artificial Sequence; identical to SEQ ID NO: 43498
  hemagglutinin__InfluenzaA__ALA08515

SEQ ID NO: 43509 - RNA, 1701 nt, Artificial Sequence; identical to SEQ ID NO: 43498
  hemagglutinin__InfluenzaA__ALA08516

SEQ ID NO: 43510 - RNA, 1701 nt, Artificial Sequence
  hemagglutinin__InfluenzaA__ALA08517
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43511 - RNA, 1701 nt, Artificial Sequence; identical to SEQ ID NO: 43498
  hemagglutinin__InfluenzaA__ALA08519

SEQ ID NO: 43512 - RNA, 1701 nt, Artificial Sequence
  hemagglutinin__InfluenzaA__ALA08520
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaccaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaaaugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43513 - RNA, 1701 nt, Artificial Sequence
  hemagglutinin__InfluenzaA__ALA08522
augaagacuaucauugcuuugagcuacauucuaugucugguuuucgcucaaaaacuuccuggaaaugacaauagcacggcaacgcugugccuugggcaccaugcaguaccaaauggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacggagcaaagccuacagcaacuguuacccuuaugaugugccggauuaugccucccuuaggucacuaguugccucauccggcacacuggaguuuaacaaugaaagcuucaauugggcuggagucacccaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucgucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaccuaauugcuccuagggguuacuucaaaauacgaagugggaaaagcucaauaaugagaucagaugcacccauuggcaaaugcaagucagaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaaacaacugagggaaaaugcugaggauaugggcaaugguuguuucaaaauauaccacaaaugugacaaugccugcauaggaucaaucagaaauggaacuuaugaccacgauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43514 - RNA, 1701 nt, Artificial Sequence
  hemagglutinin__InfluenzaA__ALA08523
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcauagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacagaaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43515 - RNA, 1701 nt, Artificial Sequence
  hemagglutinin__InfluenzaA__ALA08524
augaagacuaucauugccuugagcuacauucuauguaugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacucagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43516 - RNA, 1701 nt, Artificial Sequence; identical to SEQ ID NO: 43498
  hemagglutinin__InfluenzaA__ALA08525

SEQ ID NO: 43517 - RNA, 1701 nt, Artificial Sequence
  hemagglutinin__InfluenzaA__ALA08526
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagagaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43518 - RNA, 1701 nt, Artificial Sequence; identical to SEQ ID NO: 43510
  hemagglutinin__InfluenzaA__ALA08527

SEQ ID NO: 43519 - RNA, 1701 nt, Artificial Sequence
  hemagglutinin__InfluenzaA__ALA08528
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuaccuguaugcucaaucaucaggaagaaucacaguauccaccaagagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaaaugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43520 - RNA, 1701 nt, Artificial Sequence
  hemagglutinin__InfluenzaA__ALA08529
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43521 - RNA, 1701 nt, Artificial Sequence; identical to SEQ ID NO: 43517
  hemagglutinin__InfluenzaA__ALA08530

SEQ ID NO: 43522 - RNA, 1701 nt, Artificial Sequence
  hemagglutinin__InfluenzaA__ALA08531
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauauaccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43523 - RNA, 1701 nt, Artificial Sequence
  hemagglutinin__InfluenzaA__ALA08532
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagauccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43524 - RNA, 1701 nt, Artificial Sequence
  hemagglutinin__InfluenzaA__ALA08533
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagauccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauugguaaaugcaagucugaaugcaucacuccaaauggaagcauucccaaugacaaaccauuccaaaauguaaacaggauuacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43525 - RNA, 1701 nt, Artificial Sequence
  hemagglutinin__InfluenzaA__ALA08534
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccucuuugucgaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43526 - RNA, 1701 nt, Artificial Sequence
  hemagglutinin__InfluenzaA__ALA08535
augaagacuaucauugcuuugagcuacauucuaugucugguuuucgcucaaaaaauuccuggaaaugacaauagcacggcaacgcugugccuugggcaccaugcaguaccaaacgggacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugagcaauuugacaaauuguacauuugggggguucaccacccggguacggacaaggaccaaaucuuccuguaugcucaaucaucaggaagaauaacaguaucuaccaaaagaagccaacaagcuguaaucccaaauaucggaucuagacccagaauaagggauauuccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugagugcaucacuccaaacggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43527 - RNA, 1701 nt, Artificial Sequence
  hemagglutinin__InfluenzaA__ALA08536
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucugacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43528 - RNA, 1701 nt, Artificial Sequence
  hemagglutinin__InfluenzaA__ALA08537
augaagacuaucauugcuuugagcuacauucuaugucugguuuucgcucaaaagcuuccugaaaaugacaauagcacggcaacgcugugccuugggcaccaugcaguaccaaacggaacgauagugaagacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43529 - RNA, 1701 nt, Artificial Sequence; identical to SEQ ID NO: 43527
  hemagglutinin__InfluenzaA__ALA08538

SEQ ID NO: 43530 - RNA, 1701 nt, Artificial Sequence; identical to SEQ ID NO: 43498
  hemagglutinin__InfluenzaA__ALA08539

SEQ ID NO: 43531 - RNA, 1701 nt, Artificial Sequence; identical to SEQ ID NO: 43510
  hemagglutinin__InfluenzaA__ALA08540

SEQ ID NO: 43532 - RNA, 1701 nt, Artificial Sequence; identical to SEQ ID NO: 43528
  hemagglutinin__InfluenzaA__ALA08541

SEQ ID NO: 43533 - RNA, 1701 nt, Artificial Sequence
  hemagglutinin__InfluenzaA__ALA08542
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggggacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauauagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43534 - RNA, 1701 nt, Artificial Sequence
  hemagglutinin__InfluenzaA__ALA08543
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcugcaaucccaaauaucggaucuagacccagaauaagggauaucccuagcagaauaagcaucuauuggacaauaguaaaaccgggggacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43535 - RNA, 1701 nt, Artificial Sequence
  hemagglutinin__InfluenzaA__ALA08545
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggggacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43536 - RNA, 1701 nt, Artificial Sequence; identical to SEQ ID NO: 43535
  hemagglutinin__InfluenzaA__ALA08546

SEQ ID NO: 43537 - RNA, 1701 nt, Artificial Sequence
  hemagglutinin__InfluenzaA__ALA08548
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucgcucaaaacggaacaaguucugcuugcauaaggggaucuaauaguaguuucuuuaguagauuaaauugguugacccacucaaacuucaaauauccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43538 - RNA, 1701 nt, Artificial Sequence
  hemagglutinin__InfluenzaA__ALA08549
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaacagguguaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacggggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaggaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43539 - RNA, 1701 nt, Artificial Sequence; identical to SEQ ID NO: 43527
  hemagglutinin__InfluenzaA__ALA08550

SEQ ID NO: 43540 - RNA, 1701 nt, Artificial Sequence
  hemagglutinin__InfluenzaA__ALA08551
augaagacuaucauugcuuugagcuacauucuaugucugguuuucgcucaaaagcuucuugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43541 - RNA, 1701 nt, Artificial Sequence; identical to SEQ ID NO: 43510
  hemagglutinin__InfluenzaA__ALA08552

SEQ ID NO: 43542 - RNA, 1701 nt, Artificial Sequence; identical to SEQ ID NO: 43510
  hemagglutinin__InfluenzaA__ALA08553

SEQ ID NO: 43543 - RNA, 1701 nt, Artificial Sequence
  hemagglutinin__InfluenzaA__ALA08554
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggggacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaaggaguugagcugaugucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43544 - RNA, 1701 nt, Artificial Sequence
  hemagglutinin__InfluenzaA__ALA08555
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccaaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaguaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43545 - RNA, 1701 nt, Artificial Sequence
  hemagglutinin__InfluenzaA__ALA08556
augaagacuaucauugcuuuaagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggaaucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggggacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43546 - RNA, 1701 nt, Artificial Sequence; identical to SEQ ID NO: 43510
  hemagglutinin__InfluenzaA__ALA08557

SEQ ID NO: 43547 - RNA, 1701 nt, Artificial Sequence
  hemagglutinin__InfluenzaA__ALA08558
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucagacaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucugacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43548 - RNA, 1701 nt, Artificial Sequence
  hemagglutinin__InfluenzaA__ALA08559
augaagaccaucauugcccugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcgcagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacgggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43549 - RNA, 1701 nt, Artificial Sequence; identical to SEQ ID NO: 43535
  hemagglutinin__InfluenzaA__ALA08560

SEQ ID NO: 43550 - RNA, 1701 nt, Artificial Sequence
  hemagglutinin__InfluenzaA__ALA08561
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaggaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43551 - RNA, 1701 nt, Artificial Sequence
  hemagglutinin__InfluenzaA__ALA08563
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacuaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43552 - RNA, 1701 nt, Artificial Sequence
  hemagglutinin__InfluenzaA__ALA08571
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagauccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccacaucauguuuuuugcuuuguguugcuuuguugggguucaucaugugggccugccaaaagggcaacauuaggugcaacauuugcauuuga

SEQ ID NO: 43553 - RNA, 1701 nt, Artificial Sequence
  hemagglutinin__InfluenzaA__ALA08572
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguucaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaggucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaacggaacuuaugaccacaauguguacagggaugaagcauuaaacaaccgguuccagaucaagggaauugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43554 - RNA, 1701 nt, Artificial Sequence
  hemagglutinin__InfluenzaA__ALA08573
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguucaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaacggaacuuaugaccacaauguguacagggaugaagcauuaaacaaccgguuccagaucaagggaauugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43555 - RNA, 1701 nt, Artificial Sequence
  hemagglutinin__InfluenzaA__ALA08574
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucagugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43556 - RNA, 1701 nt, Artificial Sequence
  hemagglutinin__InfluenzaA__ALA08575
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcagagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaagacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43557 - RNA, 1701 nt, Artificial Sequence
  hemagglutinin__InfluenzaA__ALA08576
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43558 - RNA, 1701 nt, Artificial Sequence; identical to SEQ ID NO: 43498
  hemagglutinin__InfluenzaA__ALA08577

SEQ ID NO: 43559 - RNA, 1701 nt, Artificial Sequence
  hemagglutinin__InfluenzaA__ALA08579
augaagacuaucauugcuuugagcuacauucuaugucugauuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43560 - RNA, 1701 nt, Artificial Sequence
  hemagglutinin__InfluenzaA__ALA08580
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43561 - RNA, 1701 nt, Artificial Sequence
  hemagglutinin__InfluenzaA__ALA08582
augaagacuaucauugcuuugagcuacauucuaugucugguuuucgcucaaaaacuuccugaaaaugacaauagcacggcaacgcugugccuugggcaccaugcaguaccaaacggaacgauagugaaaacaaucacgaaugaccgaauugaaguuacuaaugcuacugagcuaguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguccaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucuuuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43562 - RNA, 1701 nt, Artificial Sequence
  hemagglutinin__InfluenzaA__ALA08583
augaagacuaucauugcuuugagcuacauucuaugucugguuuucgcucaaaaacuuccugaaaaugacaauagcacggcaacgcugugccuugggcaccaugcaguaccaaacggaacgauagugaaaacaaucacgaaugaccgaauugaaguuacuaaugcuacugagcuaguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguccaccacccggguacggacaaggaccaaaucuuccuguaugcucaaucaucaggaagaaucacaguauccaccaaaagaagccaacaagcuguaauuccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucuuuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43563 - RNA, 1701 nt, Artificial Sequence
  hemagglutinin__InfluenzaA__ALA08584
augaagacuaucauugcuuugagcuacauucuaugucugguuuucgcucaaaaacuuccugaaaaugacaauagcacggcaacgcugugccuugggcaccaugcaguaccaaacggaacgauagugaaaacaaucacgaaugaccgaauugaaguuacuaaugcuacugagcuaguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguccaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucuuuggucauacaacgcggagcuucuuguugcccuggagaaccaacauacaauugaucuaacugacucagaaaugaacaaacuguuugaaaaaacaaagaagcaauugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43564 - RNA, 1701 nt, Artificial Sequence
  hemagglutinin__InfluenzaA__ALA08585
augaagacuaucauugcuuugagcuacauucuaugucugguuuucgcucaaaaacuuccugaaaaugacaauagcacggcaacgcugugccuugggcaccaugcaguaccaaacggaacgauagugaaaacaaucacgaaugaccgaauugaaguuacuaaugcuacugagcuaguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauuaaacgugacuaugccaaacaaugaacaauuugacaaauuguacauuugggggguccaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucuuuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43565 - RNA, 1701 nt, Artificial Sequence
  hemagglutinin__InfluenzaA__ALA08586
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuugucgaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43566 - RNA, 1701 nt, Artificial Sequence
  hemagglutinin__InfluenzaA__ALA08587
augaagacuaucauugcuuugagcuacauucuaugucugguuuucgcucaaaaacuuccugaaaaugacaauagcacggcaacgcugugccuugggcaccaugcaguaccaaacggaacgauagugaaaacaaucacgaaugaccgaauugaaguuacuaaugcuacugagcuaguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguccaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaauggcugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucuuuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43567 - RNA, 1701 nt, Artificial Sequence; identical to SEQ ID NO: 43535
  hemagglutinin__InfluenzaA__ALA08588

SEQ ID NO: 43568 - RNA, 1701 nt, Artificial Sequence
  hemagglutinin__InfluenzaA__ALA08589
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43569 - RNA, 1701 nt, Artificial Sequence; identical to SEQ ID NO: 43561
  hemagglutinin__InfluenzaA__ALA08590

SEQ ID NO: 43570 - RNA, 1701 nt, Artificial Sequence
  hemagglutinin__InfluenzaA__ALA08591
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuagaugcaacauuugcauuuga

SEQ ID NO: 43571 - RNA, 1701 nt, Artificial Sequence; identical to SEQ ID NO: 43510
  hemagglutinin__InfluenzaA__ALA08592

SEQ ID NO: 43572 - RNA, 1701 nt, Artificial Sequence
  hemagglutinin__InfluenzaA__ALA08594
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacgggacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguccaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccaugucauguuuuuugcuuuguguugcuuuguugggguucaucaugugggccugccaaaagggcaacauuaggugcaacauuugcauuuga

SEQ ID NO: 43573 - RNA, 1701 nt, Artificial Sequence; identical to SEQ ID NO: 43568
  hemagglutinin__InfluenzaA__ALA08595

SEQ ID NO: 43574 - RNA, 1701 nt, Artificial Sequence; identical to SEQ ID NO: 43498
  hemagglutinin__InfluenzaA__ALA08596

SEQ ID NO: 43575 - RNA, 1701 nt, Artificial Sequence
  hemagglutinin__InfluenzaA__ALA08597
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaagucacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaauggcaacauuaggugcaacauuugcauuuga

SEQ ID NO: 43576 - RNA, 1701 nt, Artificial Sequence
  hemagglutinin__InfluenzaA__ALA08598
augaagacuaucauugccucgagcuacauucuauguuugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43577 - RNA, 1701 nt, Artificial Sequence; identical to SEQ ID NO: 43498
  hemagglutinin__InfluenzaA__ALA08599

SEQ ID NO: 43578 - RNA, 1701 nt, Artificial Sequence
  hemagglutinin__InfluenzaA__ALA08600
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacagauacccagcauugaacgugacuaugccaaacaaugaacaauuugacaaauuguacauuugggggguucaccacccggguacggacaaggaccaaaucucccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43579 - RNA, 1701 nt, Artificial Sequence
  hemagglutinin__InfluenzaA__ALA08601
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcuaaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43580 - RNA, 1701 nt, Artificial Sequence
  hemagglutinin__InfluenzaA__ALA08602
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugaugacuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucucccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggacaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43581 - RNA, 1701 nt, Artificial Sequence
  hemagglutinin__InfluenzaA__ALA08603
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacauauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43582 - RNA, 1701 nt, Artificial Sequence; identical to SEQ ID NO: 43498
  hemagglutinin__InfluenzaA__ALA08605

SEQ ID NO: 43583 - RNA, 1701 nt, Artificial Sequence; identical to SEQ ID NO: 43520
  hemagglutinin__InfluenzaA__ALA08606

SEQ ID NO: 43584 - RNA, 1701 nt, Artificial Sequence; identical to SEQ ID NO: 43560
  hemagglutinin__InfluenzaA__ALA08607

SEQ ID NO: 43585 - RNA, 1701 nt, Artificial Sequence
  hemagglutinin__InfluenzaA__ALA08609
augaagacuaucauugcuuugggcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucauaagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugauaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43586 - RNA, 1701 nt, Artificial Sequence
  hemagglutinin__InfluenzaA__ALA08610
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugacagaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcugcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43587 - RNA, 1701 nt, Artificial Sequence
  hemagglutinin__InfluenzaA__ALA08611
augaagauuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucggauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaagucugagugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43588 - RNA, 1701 nt, Artificial Sequence; identical to SEQ ID NO: 43560
  hemagglutinin__InfluenzaA__ALA08612

SEQ ID NO: 43589 - RNA, 1701 nt, Artificial Sequence; identical to SEQ ID NO: 43523
  hemagglutinin__InfluenzaA__ALA08614

SEQ ID NO: 43590 - RNA, 1701 nt, Artificial Sequence
  hemagglutinin__InfluenzaA__ALA08615
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucgauaggugaaauaugcgacaguccucaucagauccuugauggagaaaacugcacacuaauagaugcucuauugggagauccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43591 - RNA, 1701 nt, Artificial Sequence
  hemagglutinin__InfluenzaA__ALA08616
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuaccccuaugaugugccggauuaugccucccuuaggucacuaguugccucauccggcacacuggaguuuaacaaugaaagcuucaauuggacuggagucacucaaaacggaacaaguucugcuugcauaaggagaucuaguaguagcuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43592 - RNA, 1701 nt, Artificial Sequence; identical to SEQ ID NO: 43554
  hemagglutinin__InfluenzaA__ALA08617

SEQ ID NO: 43593 - RNA, 1701 nt, Artificial Sequence
  hemagglutinin__InfluenzaA__ALA08619
augaagacugucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaauugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugagaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaauuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43594 - RNA, 1701 nt, Artificial Sequence; identical to SEQ ID NO: 43560
  hemagglutinin__InfluenzaA__ALA08620

SEQ ID NO: 43595 - RNA, 1701 nt, Artificial Sequence; identical to SEQ ID NO: 43551
  hemagglutinin__InfluenzaA__ALA08621

SEQ ID NO: 43596 - RNA, 1701 nt, Artificial Sequence
  hemagglutinin__InfluenzaA__ALA08622
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43597 - RNA, 1701 nt, Artificial Sequence
  hemagglutinin__InfluenzaA__ALA08623
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaacuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuaggggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43598 - RNA, 1701 nt, Artificial Sequence; identical to SEQ ID NO: 43551
  hemagglutinin__InfluenzaA__ALA08624

SEQ ID NO: 43599 - RNA, 1701 nt, Artificial Sequence; identical to SEQ ID NO: 43525
  hemagglutinin__InfluenzaA__ALA08625

SEQ ID NO: 43600 - RNA, 1701 nt, Artificial Sequence
  hemagglutinin__InfluenzaA__ALA08626
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugagcaauuugacaaauuguacauuugggggguucaccacccggguacggacaaggaccaaaucuuccuguaugcucaaucaucaggaagaauaacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugagugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43601 - RNA, 1701 nt, Artificial Sequence
  hemagglutinin__InfluenzaA__ALA08627
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagagguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43602 - RNA, 1701 nt, Artificial Sequence
  hemagglutinin__InfluenzaA__ALA08629
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagauccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaagauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43603 - RNA, 1701 nt, Artificial Sequence
  hemagglutinin__InfluenzaA__ALA08630
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaacaaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43604 - RNA, 1701 nt, Artificial Sequence
  hemagglutinin__InfluenzaA__ALA08631
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaggaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43605 - RNA, 1701 nt, Artificial Sequence
  hemagglutinin__InfluenzaA__ALA08632
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucaaugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaaugucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaccagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43606 - RNA, 1701 nt, Artificial Sequence; identical to SEQ ID NO: 43510
  hemagglutinin__InfluenzaA__ALA08634

SEQ ID NO: 43607 - RNA, 1701 nt, Artificial Sequence
  hemagglutinin__InfluenzaA__ALA08635
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43608 - RNA, 1701 nt, Artificial Sequence
  hemagglutinin__InfluenzaA__ALA08636
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagauccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggauucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43609 - RNA, 1701 nt, Artificial Sequence; identical to SEQ ID NO: 43510
  hemagglutinin__InfluenzaA__ALA08637

SEQ ID NO: 43610 - RNA, 1701 nt, Artificial Sequence
  hemagglutinin__InfluenzaA__ALA08638
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggggacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43611 - RNA, 1701 nt, Artificial Sequence; identical to SEQ ID NO: 43510
  hemagglutinin__InfluenzaA__ALA08639

SEQ ID NO: 43612 - RNA, 1701 nt, Artificial Sequence; identical to SEQ ID NO: 43527
  hemagglutinin__InfluenzaA__ALA08640

SEQ ID NO: 43613 - RNA, 1701 nt, Artificial Sequence; identical to SEQ ID NO: 43510
  hemagglutinin__InfluenzaA__ALA08641

SEQ ID NO: 43614 - RNA, 1701 nt, Artificial Sequence; identical to SEQ ID NO: 43510
  hemagglutinin__InfluenzaA__ALA08642

SEQ ID NO: 43615 - RNA, 1701 nt, Artificial Sequence; identical to SEQ ID NO: 43510
  hemagglutinin__InfluenzaA__ALA08643

SEQ ID NO: 43616 - RNA, 1701 nt, Artificial Sequence; identical to SEQ ID NO: 43535
  hemagglutinin__InfluenzaA__ALA08644

SEQ ID NO: 43617 - RNA, 1701 nt, Artificial Sequence
  hemagglutinin__InfluenzaA__ALA08645
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauugaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagauaucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcucuguguugcuuuguugggguucaucaugugggccugccaaaagggcaacaucaggugcaacauuugcauuuga

SEQ ID NO: 43618 - RNA, 1701 nt, Artificial Sequence; identical to SEQ ID NO: 43498
  hemagglutinin__InfluenzaA__ALA08646

SEQ ID NO: 43619 - RNA, 1701 nt, Artificial Sequence; identical to SEQ ID NO: 43600
  hemagglutinin__InfluenzaA__ALA08647

SEQ ID NO: 43620 - RNA, 1701 nt, Artificial Sequence; identical to SEQ ID NO: 43510
  hemagglutinin__InfluenzaA__ALA08648

SEQ ID NO: 43621 - RNA, 1701 nt, Artificial Sequence
  hemagglutinin__InfluenzaA__ALA08650
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaacgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccucuuugucgaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaauuccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43622 - RNA, 1701 nt, Artificial Sequence; identical to SEQ ID NO: 43510
  hemagglutinin__InfluenzaA__ALA08652

SEQ ID NO: 43623 - RNA, 1701 nt, Artificial Sequence; identical to SEQ ID NO: 43535
  hemagglutinin__InfluenzaA__ALA08653

SEQ ID NO: 43624 - RNA, 1701 nt, Artificial Sequence
  hemagglutinin__InfluenzaA__ALA08654
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugagcaauuugacaaauuguacauuugggggguucaccacccggguacggacaaggaccaaaucuuccuguaugcucaaucaucaggaagaauaacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugagugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugcuugcauaggaucaauaagaaauggaacuuaugaccacaauguguacagggaugaagcauuaaacaaccgguuccagaucaagggaguugagcugaagucaggguacaaagauuggauccuauggauuuccuuugccaaaucauguuuuuugcuuuguguugcuuuguugggguucaucaugugggccugccaaaagggcaacauuaggugcaacauuugcauuuga

SEQ ID NO: 43625 - RNA, 1701 nt, Artificial Sequence; identical to SEQ ID NO: 43510
  hemagglutinin__InfluenzaA__ALA08655

SEQ ID NO: 43626 - RNA, 1701 nt, Artificial Sequence
  hemagglutinin__InfluenzaA__ALA08656
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuauagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucugacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43627 - RNA, 1701 nt, Artificial Sequence
  hemagglutinin__InfluenzaA__ALA08657
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucaaaauuccucaauaggugaaauaugcgacaguccucaucagauccuugauggaaaaaacugcacacuaauagaugcucuauugggagacccucagugugauggcuuucaaaauaagaaaugggaccuuuuuauugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43628 - RNA, 1701 nt, Artificial Sequence; identical to SEQ ID NO: 43510
  hemagglutinin__InfluenzaA__ALA08658

SEQ ID NO: 43629 - RNA, 1701 nt, Artificial Sequence
  hemagglutinin__InfluenzaA__ALA08659
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagauccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43630 - RNA, 1701 nt, Artificial Sequence
  hemagglutinin__InfluenzaA__ALA08660
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauggcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggacaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacaucaggugcaacauuugcauuuga

SEQ ID NO: 43631 - RNA, 1701 nt, Artificial Sequence
  hemagglutinin__InfluenzaA__ALA08662
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacuaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacucuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43632 - RNA, 1701 nt, Artificial Sequence
  hemagglutinin__InfluenzaA__ALA08663
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43633 - RNA, 1701 nt, Artificial Sequence; identical to SEQ ID NO: 43631
  hemagglutinin__InfluenzaA__ALA08665

SEQ ID NO: 43634 - RNA, 1701 nt, Artificial Sequence
  hemagglutinin__InfluenzaA__ALA08666
augaagacuaucauugcuuugagcuacauucuaugucugguuuucgcucaaaaacuuccuggaaaugacaauagcacggcaacgcugugccuugggcaccaugcaguaccaaauggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucaaugugauggcuuucaaaauaagaaaugggaccuuuuuguugaacggagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucgucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaccuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaagacacaaaaauagaucucuggucauacaacgcagagcuucuuguugcccuggagaaccaacauacaauugaucuaacugacucagaaaugaacaaacuguuugaaaaaacaaagaaacaacugagggaaaaugcugaggauaugggcaaugguuguuucaaaauauaccacaaaugugacaaugccugcauaggaucaaucagaaauggaacuuaugaccacgauguguacagggaugaagcauuaaacaaccgguuccagaucaagggaguugagcugaagucaggguacaaagauuggauccuauggauuuccuuugccaugucauguuuuuugcuuuguguugcuuuguugggguucaucaugugggccugccaaaagggcaacauuaggugcaacauuugcauuuga

SEQ ID NO: 43635 - RNA, 1701 nt, Artificial Sequence
  hemagglutinin__InfluenzaA__ALA08667
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43636 - RNA, 1701 nt, Artificial Sequence
  hemagglutinin__InfluenzaA__ALA08668
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauuuucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcaauaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43637 - RNA, 1701 nt, Artificial Sequence
  hemagglutinin__InfluenzaA__ALA08669
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43638 - RNA, 1701 nt, Artificial Sequence; identical to SEQ ID NO: 43496
  hemagglutinin__InfluenzaA__ALA08670

SEQ ID NO: 43639 - RNA, 1701 nt, Artificial Sequence; identical to SEQ ID NO: 43637
  hemagglutinin__InfluenzaA__ALA08671

SEQ ID NO: 43640 - RNA, 1701 nt, Artificial Sequence
  hemagglutinin__InfluenzaA__ALA08672
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaauguaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43641 - RNA, 1701 nt, Artificial Sequence; identical to SEQ ID NO: 43496
  hemagglutinin__InfluenzaA__ALA08673

SEQ ID NO: 43642 - RNA, 1701 nt, Artificial Sequence; identical to SEQ ID NO: 43637
  hemagglutinin__InfluenzaA__ALA08674

SEQ ID NO: 43643 - RNA, 1701 nt, Artificial Sequence; identical to SEQ ID NO: 43600
  hemagglutinin__InfluenzaA__ALA08675

SEQ ID NO: 43644 - RNA, 1701 nt, Artificial Sequence; identical to SEQ ID NO: 43632
  hemagglutinin__InfluenzaA__ALA08676

SEQ ID NO: 43645 - RNA, 1701 nt, Artificial Sequence; identical to SEQ ID NO: 43632
  hemagglutinin__InfluenzaA__ALA08677

SEQ ID NO: 43646 - RNA, 1701 nt, Artificial Sequence; identical to SEQ ID NO: 43632
  hemagglutinin__InfluenzaA__ALA08678

SEQ ID NO: 43647 - RNA, 1701 nt, Artificial Sequence
  hemagglutinin__InfluenzaA__ALA08679
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagauccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43648 - RNA, 1701 nt, Artificial Sequence; identical to SEQ ID NO: 43637
  hemagglutinin__InfluenzaA__ALA08680

SEQ ID NO: 43649 - RNA, 1701 nt, Artificial Sequence; identical to SEQ ID NO: 43510
  hemagglutinin__InfluenzaA__ALA08681

SEQ ID NO: 43650 - RNA, 1701 nt, Artificial Sequence
  hemagglutinin__InfluenzaA__ALA08682
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacauauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43651 - RNA, 1701 nt, Artificial Sequence; identical to SEQ ID NO: 43510
  hemagglutinin__InfluenzaA__ALA08683

SEQ ID NO: 43652 - RNA, 1701 nt, Artificial Sequence
  hemagglutinin__InfluenzaA__ALA08684
augaagacuaucauugccuugagccacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucauuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaagagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaauugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43653 - RNA, 1701 nt, Artificial Sequence; identical to SEQ ID NO: 43498
  hemagglutinin__InfluenzaA__ALA08686

SEQ ID NO: 43654 - RNA, 1701 nt, Artificial Sequence
  hemagglutinin__InfluenzaA__ALA08687
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaauugccucauccggcacacuggaguuuaacaaugaaagcuucaauuggacuggagucacucaaaacggaacaaguucugcuugcauaaggagaucuaguaguaguuucuuuagcagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaauugaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43655 - RNA, 1701 nt, Artificial Sequence
  hemagglutinin__InfluenzaA__ALA08688
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggggacccucagugugauggcuuucaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43656 - RNA, 1701 nt, Artificial Sequence
  hemagglutinin__InfluenzaA__ALE31612
augaagacuaucauugcuuugagcuacauucuaugucugguuuucgcucaaaaaauuccuggaaaugacaauagcacggcaacgcugugccuugggcaccaugcaguaccaaauggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagauccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43657 - RNA, 1701 nt, Artificial Sequence
  hemagglutinin__InfluenzaA__ALE31613
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuagcagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucaugucuuuugcuuuguguugcuuuguugggguucaucaugugggccugccaaaagggcaacauuaggugcaacauuugcauuuga

SEQ ID NO: 43658 - RNA, 1701 nt, Artificial Sequence
  hemagglutinin__InfluenzaA__ALE31614
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauagguaaaauaugcgacaguccucaucagauccuugauggagaaaacugcacacuaauagaugcucuauugggagauccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacccaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccaaaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43659 - RNA, 1701 nt, Artificial Sequence
  hemagglutinin__InfluenzaA__ALE31615
augaagacuaucauugcuuugagcuacauucuaugucugguuuucgcucaaaaacuuccuggaaaugacaauagcacggcaacgcugugccuugggcaccaugcaguaccaaauggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucaaugugauggcuuucaaaauaagaaaugggaccuuuuuguugaacggagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucgucaggaaggaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaccuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaagacacaaaaauagaucucuggucauacaacgcagagcuucuuguugcccuggagaaccaacauacaauugaucuaacugacucagaaaugaacaaacuguuugaaaaaacaaagaaacaacugagggaaaaugcugaggauaugggcaaugguuguuucaaaauauaccacaaaugugacaaugccugcauagaaucaaucagaaauggaacuuaugaccacgauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43660 - RNA, 1701 nt, Artificial Sequence
  hemagglutinin__InfluenzaA__ALE31616
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaccucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43661 - RNA, 1701 nt, Artificial Sequence; identical to SEQ ID NO: 43557
  hemagglutinin__InfluenzaA__ALE31617

SEQ ID NO: 43662 - RNA, 1701 nt, Artificial Sequence; identical to SEQ ID NO: 43600
  hemagglutinin__InfluenzaA__ALE31618

SEQ ID NO: 43663 - RNA, 1701 nt, Artificial Sequence
  hemagglutinin__InfluenzaA__ALE31619
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacaucugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43664 - RNA, 1701 nt, Artificial Sequence
  hemagglutinin__InfluenzaA__ALE31620
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagagaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43665 - RNA, 1701 nt, Artificial Sequence
  hemagglutinin__InfluenzaA__ALE31622
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggggacauacuuuugauuaacagcacagggaaucuaauugcuccuagggguuacuucaaaauacgaagugggaaaagcucaauaaugagaucagauguacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43666 - RNA, 1701 nt, Artificial Sequence
  hemagglutinin__InfluenzaA__ALE31623
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggggacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaagcuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43667 - RNA, 1701 nt, Artificial Sequence
  hemagglutinin__InfluenzaA__ALE31625
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuagcagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaauugaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43668 - RNA, 1701 nt, Artificial Sequence
  hemagglutinin__InfluenzaA__ALE31626
augaagaccaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaaaaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuugaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaccuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43669 - RNA, 1701 nt, Artificial Sequence
  hemagglutinin__InfluenzaA__ALE31627
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaccagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43670 - RNA, 1701 nt, Artificial Sequence; identical to SEQ ID NO: 43520
  hemagglutinin__InfluenzaA__ALE31628

SEQ ID NO: 43671 - RNA, 1701 nt, Artificial Sequence; identical to SEQ ID NO: 43607
  hemagglutinin__InfluenzaA__ALE31629

SEQ ID NO: 43672 - RNA, 1701 nt, Artificial Sequence; identical to SEQ ID NO: 43568
  hemagglutinin__InfluenzaA__ALE31632

SEQ ID NO: 43673 - RNA, 1701 nt, Artificial Sequence
  hemagglutinin__InfluenzaA__ALE31634
augaagacuaucauugcuuugagcuacauucuaugucugguucucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43674 - RNA, 1701 nt, Artificial Sequence; identical to SEQ ID NO: 43520
  hemagglutinin__InfluenzaA__ALE31635

SEQ ID NO: 43675 - RNA, 1701 nt, Artificial Sequence; identical to SEQ ID NO: 43520
  hemagglutinin__InfluenzaA__ALE31636

SEQ ID NO: 43676 - RNA, 1701 nt, Artificial Sequence
  hemagglutinin__InfluenzaA__ALE31638
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugagcaauuugacaaauuguacauuugggggguucaccacccggguacggacaaggaccaaaucuuccuguaugcucaaucaucaggaagaauaacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugagugcaucacuccaaauggaagcauucccaauggcaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuauuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43677 - RNA, 1701 nt, Artificial Sequence
  hemagglutinin__InfluenzaA__ALE31639
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagauccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43678 - RNA, 1701 nt, Artificial Sequence; identical to SEQ ID NO: 43496
  hemagglutinin__InfluenzaA__ALE31640

SEQ ID NO: 43679 - RNA, 1701 nt, Artificial Sequence; identical to SEQ ID NO: 43510
  hemagglutinin__InfluenzaA__ALE31641

SEQ ID NO: 43680 - RNA, 1701 nt, Artificial Sequence; identical to SEQ ID NO: 43510
  hemagglutinin__InfluenzaA__ALE31642

SEQ ID NO: 43681 - RNA, 1701 nt, Artificial Sequence
  hemagglutinin__InfluenzaA__ALE31643
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcacagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucagggagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43682 - RNA, 1701 nt, Artificial Sequence; identical to SEQ ID NO: 43498
  hemagglutinin__InfluenzaA__ALE31644

SEQ ID NO: 43683 - RNA, 1701 nt, Artificial Sequence; identical to SEQ ID NO: 43498
  hemagglutinin__InfluenzaA__ALE31645

SEQ ID NO: 43684 - RNA, 1701 nt, Artificial Sequence; identical to SEQ ID NO: 43498
  hemagglutinin__InfluenzaA__ALE31646

SEQ ID NO: 43685 - RNA, 1701 nt, Artificial Sequence; identical to SEQ ID NO: 43510
  hemagglutinin__InfluenzaA__ALE31647

SEQ ID NO: 43686 - RNA, 1701 nt, Artificial Sequence
  hemagglutinin__InfluenzaA__ALE31648
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuaccccuaugaugugccggauuaugccucccuuaggucacuaguugcuucauccggcacacuggaguuuaacaaugaaagcuucaauuggacuggagucacucaaaacggaacaaguucugcuugcauaaggagaucuaguaguagcuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaccaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacucaagcagcaaccgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43687 - RNA, 1701 nt, Artificial Sequence; identical to SEQ ID NO: 43520
  hemagglutinin__InfluenzaA__ALE31649

SEQ ID NO: 43688 - RNA, 1701 nt, Artificial Sequence; identical to SEQ ID NO: 43510
  hemagglutinin__InfluenzaA__ALE31650

SEQ ID NO: 43689 - RNA, 1701 nt, Artificial Sequence
  hemagglutinin__InfluenzaA__ALE31652
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucucccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43690 - RNA, 1701 nt, Artificial Sequence
  hemagglutinin__InfluenzaA__ALE31653
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggcuugccaaaagggcaacauuaggugcaacauuugcauuuga

SEQ ID NO: 43691 - RNA, 1701 nt, Artificial Sequence
  hemagglutinin__InfluenzaA__ALE31654
augaagacuaucauugcuuugagcuacauucuaugucugguuuucgcucaaaaaauuccuggaaaugacaauagcacggcaacgcugugucuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuaccccuaugaugugccggauuaugccucccuuaggucacuaguugccucauccggcacacuggaguuuaacaaugaaagcuucaauuggacuggagucacucaaaacggaacaaguucugcuugcauaaggagaucuaguaguagcuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43692 - RNA, 1701 nt, Artificial Sequence; identical to SEQ ID NO: 43520
  hemagglutinin__InfluenzaA__ALE31655

SEQ ID NO: 43693 - RNA, 1701 nt, Artificial Sequence
  hemagglutinin__InfluenzaA__ALE31656
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggacauuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43694 - RNA, 1701 nt, Artificial Sequence
  hemagglutinin__InfluenzaA__ALE31657
augaagacuaucauugcuuugagcuacauucuaugucugguuuccgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43695 - RNA, 1701 nt, Artificial Sequence
  hemagglutinin__InfluenzaA__ALE31658
augaagacuaucauugcuuugagcuacauucuaugucugguuuucgcucaaaaaauuccuggaaaugacaauagcacggcaacgcugugccuugggcaccaugcaguaccaaacggaacaauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43696 - RNA, 1701 nt, Artificial Sequence
  hemagglutinin__InfluenzaA__ALE31659
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccauccggguacggacaaggaccaaaucuuccuguaugcucgaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43697 - RNA, 1701 nt, Artificial Sequence
  hemagglutinin__InfluenzaA__ALE31660
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagagggcaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43698 - RNA, 1701 nt, Artificial Sequence
  hemagglutinin__InfluenzaA__ALE31661
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucagaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaaaaagccaacaagcuguaaucccaaauaucggaucuagacccagaauaagggauaucccuagcagaauaagcaucuauuggacaauaguaaaaccgggagacauacuuuugauuaacagcacaggaaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43699 - RNA, 1701 nt, Artificial Sequence
  hemagglutinin__InfluenzaA__ALE31662
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucgcaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucaugucuuuugcuuuguguugcuuuguugggguucaucaugugggccugccaaaagggcaacauuaggugcaacauuugcauuuga

SEQ ID NO: 43700 - RNA, 1701 nt, Artificial Sequence
  hemagglutinin__InfluenzaA__ALE31663
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaacaagaaaugggaccuuuuuguugaacgaagcaaagccuacagcaacuguuacccuuaugaugugccggauuaugccucccuuaggucacuaguugccucauccggcacacuggaguuuaacaaugaaaguuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaucaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcggcagaucucaaaagcacucaagcagcaaucgaucaaaucaaugggaagcugaaucgauugaucgggaaaaccaacgagaaauuccaucagauugaaaaggaauucucagaaguagaagggagaauucaggaccuugagaaauauguugaggacacaaaaauagaucucuggucauacaacgcggagcuucuuguugcccuggagaaccaacacacaauugaucuaacugacucagaaaugaacaaacuguuugaaaaaacaaagaagcaacugagggagaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43701 - RNA, 1701 nt, Artificial Sequence
  hemagglutinin__InfluenzaA__ALE31666
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaaauacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43702 - RNA, 1701 nt, Artificial Sequence
  hemagglutinin__InfluenzaA__ALE31667
augaagacuaucauugcuuugagcuacauucuaugucugguuuucgcucaaaaaauuccuggaaaugacaauagcacggcaacgcugugccuugggcaccaugcaguacuaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43703 - RNA, 1701 nt, Artificial Sequence
  hemagglutinin__InfluenzaA__ALE31668
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaacgaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccaucggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaacucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43704 - RNA, 1701 nt, Artificial Sequence
  hemagglutinin__InfluenzaA__ALE31669
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggggacauacuuuugauuaacagcacagggaaucuaauugcuccuagggguuauuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43705 - RNA, 1701 nt, Artificial Sequence
  hemagglutinin__InfluenzaA__ALE31670
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaagggguucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcugcaaucgaucaaaucaaugggaagcugaaucgauugaucgggaagaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaaaugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43706 - RNA, 1701 nt, Artificial Sequence
  hemagglutinin__InfluenzaA__ALE31671
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuauuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43707 - RNA, 1701 nt, Artificial Sequence
  hemagglutinin__InfluenzaA__ALE31672
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuaggcccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagagaugaacaaacuguuugaaaaaacaaagaagcaacugagggaaaaugcugaggauaugggaaaugguuguuucaaaauauaccacaaaugugacaaugccugcauaggaucaauaagaaauggaacuuacgaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43708 - RNA, 1701 nt, Artificial Sequence
  hemagglutinin__InfluenzaA__ALE31673
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggggacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43709 - RNA, 1701 nt, Artificial Sequence
  hemagglutinin__InfluenzaA__ALE31674
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuaccaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucacucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43710 - RNA, 1701 nt, Artificial Sequence
  hemagglutinin__InfluenzaA__ALE31675
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcaacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacgcuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43711 - RNA, 1701 nt, Artificial Sequence
  hemagglutinin__InfluenzaA__ALE31676
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccaaaauaagggauaucccuagcagaauaagcaucuauuggacaauaguaaaaccgggagacauacuuuugauuaacagcacagggaaucuaauugcuccuagggguuacuucaaaauacuaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacucuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43712 - RNA, 1701 nt, Artificial Sequence
  hemagglutinin__InfluenzaA__ALE31677
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauuaggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43713 - RNA, 1701 nt, Artificial Sequence
  hemagglutinin__InfluenzaA__ALE31678
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggauggcugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43714 - RNA, 1701 nt, Artificial Sequence
  hemagglutinin__InfluenzaA__ALE31679
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugauucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43715 - RNA, 1701 nt, Artificial Sequence; identical to SEQ ID NO: 43561
  hemagglutinin__InfluenzaA__ALE31680

SEQ ID NO: 43716 - RNA, 1701 nt, Artificial Sequence; identical to SEQ ID NO: 43560
  hemagglutinin__InfluenzaA__ALE31681

SEQ ID NO: 43717 - RNA, 1701 nt, Artificial Sequence; identical to SEQ ID NO: 43520
  hemagglutinin__InfluenzaA__ALE31682

SEQ ID NO: 43718 - RNA, 1701 nt, Artificial Sequence; identical to SEQ ID NO: 43520
  hemagglutinin__InfluenzaA__ALE31683

SEQ ID NO: 43719 - RNA, 1701 nt, Artificial Sequence; identical to SEQ ID NO: 43520
  hemagglutinin__InfluenzaA__ALE31684

SEQ ID NO: 43720 - RNA, 1701 nt, Artificial Sequence
  hemagglutinin__InfluenzaA__ALE31685
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucgggucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43721 - RNA, 1701 nt, Artificial Sequence
  hemagglutinin__InfluenzaA__ALE31686
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggacgguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugcuugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43722 - RNA, 1701 nt, Artificial Sequence
  hemagglutinin__InfluenzaA__ALE31687
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauagaaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43723 - RNA, 1701 nt, Artificial Sequence
  hemagglutinin__InfluenzaA__ALE31688
augaagacuaccauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaauuuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43724 - RNA, 1701 nt, Artificial Sequence
  hemagglutinin__InfluenzaA__ALE31689
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugagcaauuugacaaauuguacauuugggggguucaccacccggguacggacaaggaccaaaucuuccuguaugcucaaucaucaggaagaauaacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugagugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuauuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43725 - RNA, 1701 nt, Artificial Sequence
  hemagglutinin__InfluenzaA__ALE31690
augaagacuaucauugcuuugagcugcauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaacuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggaguaacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaucaucaggaagaaucacaguaucuaccaaaagaagccaacaagcuguaaucccgaauaucggaucuagacccagaauaagggauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43726 - RNA, 1701 nt, Artificial Sequence
  hemagglutinin__InfluenzaA__ALE31691
augaagacuaucauugcuuugagcuacauucuaugucugguuuucgcucaaaaacuuccuggaaaugacaauagcacggcaacgcugugccuugggcaccaugcaguaccaaauggaacuauagugaaaacaaucacgaaugaccgaauugaaguuacuaaugcuacugaacugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacggagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucgucagggagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaccuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacccugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaaacaacugagggaaaaugcugaggauaugggcaaugguuguuucaaaauauaccacaaaugugacaaugccugcauaggaucaaucagaaauggaacuuaugaccacgauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43727 - RNA, 1701 nt, Artificial Sequence
  hemagglutinin__InfluenzaA__ALE31692
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggauauagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43728 - RNA, 1701 nt, Artificial Sequence; identical to SEQ ID NO: 43727
  hemagglutinin__InfluenzaA__ALE31693

SEQ ID NO: 43729 - RNA, 1701 nt, Artificial Sequence
  hemagglutinin__InfluenzaA__ALE31694
augaagacuaucauugccuugagcuacauucuaugucugguuuucgcucaaaaaauuccuggaaaugauaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43730 - RNA, 1701 nt, Artificial Sequence; identical to SEQ ID NO: 43727
  hemagglutinin__InfluenzaA__ALE31695

SEQ ID NO: 43731 - RNA, 1701 nt, Artificial Sequence
  hemagglutinin__InfluenzaA__ALE31696
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaaacaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43732 - RNA, 1701 nt, Artificial Sequence; identical to SEQ ID NO: 43727
  hemagglutinin__InfluenzaA__ALE31697

SEQ ID NO: 43733 - RNA, 1701 nt, Artificial Sequence
  hemagglutinin__InfluenzaA__ALE31698
augaagacuaucauugcuuugagcuacauucuauguaugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagauccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucgauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43734 - RNA, 1701 nt, Artificial Sequence
  hemagglutinin__InfluenzaA__ALE31699
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccgaauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacgcauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43735 - RNA, 1701 nt, Artificial Sequence; identical to SEQ ID NO: 43498
  hemagglutinin__InfluenzaA__ALE31700

SEQ ID NO: 43736 - RNA, 1701 nt, Artificial Sequence
  hemagglutinin__InfluenzaA__ALE31701
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugagcaauuugacaaauuguacauuugggggguucaccacccggguacggacaaggaccaaaucuuccuguaugcucaaucaucaggaagaauaacaguaucuaccaaaagaagccaacaagcuguaauuccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugagugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagagaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43737 - RNA, 1701 nt, Artificial Sequence; identical to SEQ ID NO: 43510
  hemagglutinin__InfluenzaA__ALE31702

SEQ ID NO: 43738 - RNA, 1701 nt, Artificial Sequence
  hemagglutinin__InfluenzaA__ALE31703
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauucaucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugagcaauuugacaaauuguacauuugggggguucaccacccggguacggacaaggaccaaaucuuccuguaugcucaaucaucaggaagaauaacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugagugcaucacuccaaacggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43739 - RNA, 1701 nt, Artificial Sequence; identical to SEQ ID NO: 43568
  hemagglutinin__InfluenzaA__ALE31704

SEQ ID NO: 43740 - RNA, 1701 nt, Artificial Sequence; identical to SEQ ID NO: 43510
  hemagglutinin__InfluenzaA__ALE31705

SEQ ID NO: 43741 - RNA, 1701 nt, Artificial Sequence
  hemagglutinin__InfluenzaA__ALE31706
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaagauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucaugucuuuugcuuuguguugcuuuguugggguucaucaugugggccugccaaaagggcaacauuaggugcaacauuugcauuuga

SEQ ID NO: 43742 - RNA, 1701 nt, Artificial Sequence; identical to SEQ ID NO: 43631
  hemagglutinin__InfluenzaA__ALE31707

SEQ ID NO: 43743 - RNA, 1701 nt, Artificial Sequence; identical to SEQ ID NO: 43631
  hemagglutinin__InfluenzaA__ALE31708

SEQ ID NO: 43744 - RNA, 1701 nt, Artificial Sequence
  hemagglutinin__InfluenzaA__ALE31709
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaucaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuagaugcaacauuugcauuuga

SEQ ID NO: 43745 - RNA, 1701 nt, Artificial Sequence
  hemagglutinin__InfluenzaA__ALE31710
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacucagaauaagggauaucccuagcagaauaagcaucuauuggacaauaguaaaaccgggagacauacuuuugauuaacagcacagggaaucuaauugcuccuagggguuacuucaaaauacuaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacagacuagaggcauauuuggcgcaauagcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacucuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43746 - RNA, 1701 nt, Artificial Sequence
  hemagglutinin__InfluenzaA__ALE31711
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacuaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacagacuagaggcauauuuggcgcaauagcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacucuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43747 - RNA, 1701 nt, Artificial Sequence; identical to SEQ ID NO: 43491
  hemagglutinin__InfluenzaA__ALE31712

SEQ ID NO: 43748 - RNA, 1701 nt, Artificial Sequence
  hemagglutinin__InfluenzaA__ALE31713
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggauucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauauaccagagaaacaaacuaaaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaucgguuccagaucaagggaguugagcugaagucaggguacaaagauuggauccuauggauuuccuuugccacaucauguuuuuugcuuuguguugcuuuguugggguucaucaugugggccugccaaaagggcaacauuaggugcaacauuugcauuuga

SEQ ID NO: 43749 - RNA, 1701 nt, Artificial Sequence; identical to SEQ ID NO: 43632
  hemagglutinin__InfluenzaA__ALE31714

SEQ ID NO: 43750 - RNA, 1701 nt, Artificial Sequence
  hemagglutinin__InfluenzaA__ALE31715
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacugacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuauuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43751 - RNA, 1701 nt, Artificial Sequence
  hemagglutinin__InfluenzaA__ALE31716
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacuaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacucuaaaauagaucucuggucauauaacgcagagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43752 - RNA, 1701 nt, Artificial Sequence
  hemagglutinin__InfluenzaA__ALE31717
augaagacuaucauugcuuugagcuacauucuaugucugguuuucgcucaaaaaauuccuggaaaugacaauagcacagcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaacaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaccacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43753 - RNA, 1701 nt, Artificial Sequence; identical to SEQ ID NO: 43632
  hemagglutinin__InfluenzaA__ALE31718

SEQ ID NO: 43754 - RNA, 1701 nt, Artificial Sequence
  hemagglutinin__InfluenzaA__ALE31719
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauauaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43755 - RNA, 1701 nt, Artificial Sequence; identical to SEQ ID NO: 43629
  hemagglutinin__InfluenzaA__ALE31720

SEQ ID NO: 43756 - RNA, 1701 nt, Artificial Sequence; identical to SEQ ID NO: 43510
  hemagglutinin__InfluenzaA__ALE31721

SEQ ID NO: 43757 - RNA, 1701 nt, Artificial Sequence
  hemagglutinin__InfluenzaA__ALE31722
augaagacuaucauugcuuugagcugcauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaacuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaucaucaggaagaaucacaguaucuaccaaaagaagccaacaagcuguaaucccgaauaucggaucuagacccagaauaagggauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43758 - RNA, 1701 nt, Artificial Sequence
  hemagglutinin__InfluenzaA__ALE31723
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaaugugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaccacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43759 - RNA, 1701 nt, Artificial Sequence; identical to SEQ ID NO: 43568
  hemagglutinin__InfluenzaA__ALE31724

SEQ ID NO: 43760 - RNA, 1701 nt, Artificial Sequence; identical to SEQ ID NO: 43498
  hemagglutinin__InfluenzaA__ALE31725

SEQ ID NO: 43761 - RNA, 1701 nt, Artificial Sequence; identical to SEQ ID NO: 43568
  hemagglutinin__InfluenzaA__ALE31726

SEQ ID NO: 43762 - RNA, 1701 nt, Artificial Sequence; identical to SEQ ID NO: 43607
  hemagglutinin__InfluenzaA__ALE31727

SEQ ID NO: 43763 - RNA, 1701 nt, Artificial Sequence
  hemagglutinin__InfluenzaA__ALE31728
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuauaccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcgcccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43764 - RNA, 1701 nt, Artificial Sequence
  hemagglutinin__InfluenzaA__ALE31729
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagaucauugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43765 - RNA, 1701 nt, Artificial Sequence
  hemagglutinin__InfluenzaA__ALE31730
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugagcaauuugacaaauuguacauuugggggguucaccacccggguacggacaaggaccaaaucuuccuguacgcucaaucaucaggaagaauaacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugagugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43766 - RNA, 1701 nt, Artificial Sequence
  hemagglutinin__InfluenzaA__ALE31731
augaagacuaucauugcuuugagcuacauucuaugucagguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43767 - RNA, 1701 nt, Artificial Sequence
  hemagglutinin__InfluenzaA__ALE31732
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguucgaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43768 - RNA, 1701 nt, Artificial Sequence; identical to SEQ ID NO: 43632
  hemagglutinin__InfluenzaA__ALE31733

SEQ ID NO: 43769 - RNA, 1701 nt, Artificial Sequence
  hemagglutinin__InfluenzaA__ALE31734
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaaauacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggauuuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43770 - RNA, 1701 nt, Artificial Sequence
  hemagglutinin__InfluenzaA__ALE31735
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43771 - RNA, 1701 nt, Artificial Sequence; identical to SEQ ID NO: 43510
  hemagglutinin__InfluenzaA__ALE31736

SEQ ID NO: 43772 - RNA, 1701 nt, Artificial Sequence
  hemagglutinin__InfluenzaA__ALE31737
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43773 - RNA, 1701 nt, Artificial Sequence
  hemagglutinin__InfluenzaA__ALE31738
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43774 - RNA, 1701 nt, Artificial Sequence
  hemagglutinin__InfluenzaA__ALE31739
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaucaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43775 - RNA, 1701 nt, Artificial Sequence
  hemagglutinin__InfluenzaA__ALE31741
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaagugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43776 - RNA, 1701 nt, Artificial Sequence
  hemagglutinin__InfluenzaA__ALE31742
augaagacuaucauugcuuugagcuacauucuaugucuggguuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggacaucccuagcagaauaagcaucuacuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacagggucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43777 - RNA, 1701 nt, Artificial Sequence; identical to SEQ ID NO: 43510
  hemagglutinin__InfluenzaA__ALE31743

SEQ ID NO: 43778 - RNA, 1701 nt, Artificial Sequence; identical to SEQ ID NO: 43600
  hemagglutinin__InfluenzaA__ALE31744

SEQ ID NO: 43779 - RNA, 1701 nt, Artificial Sequence
  hemagglutinin__InfluenzaA__ALE31745
augaagacuaucauugcuuugagcuacauucuaugucugguuuucgcucaaaaacuuccuggaaaugacaauagcacggcaacgcugugccuugggcaccaugcaguaccaaacggaacgauagugaaaacgaucacgaaugaccgaauugaaguuacuaaugcuacugagcugguucagaauuccucaauaggugaaauaugcgacaguccucaucagauccuugauggaaaaaacugcacucuaauagaugcucuauugggagacccucagugugauggcuuucaaaauaagagaugggaccuuuuuguugaacgaagcaaagccuacagcaacuguuacccuuaugaugugccggauuaugccucccuuaggucacuaguugccucauccggcacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacagacaaggaccaaaucuuccuguacgcucaaucaucaggaagaaucacaguaucuaccaaaagaagccaacaagcuguaaucccgaauaucggaucuagacucagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaagucugaaugcaucacuccaaauggaagcauucccaaugacaaaccauuccaaaauguaaacaagaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaccucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43780 - RNA, 1701 nt, Artificial Sequence
  hemagglutinin__InfluenzaA__ALE31747
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggaaaaaacugcacucuaauagaugcucuauugggagacccucagugugauggcuuucaaaauaagagaugggaccuuuuuguugaacgaagcaaagccuacagcaacuguuacccuuaugaugugccggauuaugccucccuuaggucacuaguugccucauccggcacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacagacaaggaccaaaucuuccuguacgcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaguucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43781 - RNA, 1701 nt, Artificial Sequence; identical to SEQ ID NO: 43510
  hemagglutinin__InfluenzaA__ALE31748

SEQ ID NO: 43782 - RNA, 1701 nt, Artificial Sequence; identical to SEQ ID NO: 43660
  hemagglutinin__InfluenzaA__ALE31749

SEQ ID NO: 43783 - RNA, 1701 nt, Artificial Sequence
  hemagglutinin__InfluenzaA__ALE31750
augaagacuaucauugccuugagcuacauucuaugucugguuuucgcucaaaaaauuccuggaaaugacaauagcacggcaacgcugugccuuggacaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43784 - RNA, 1701 nt, Artificial Sequence
  hemagglutinin__InfluenzaA__ALE31751
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuagacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43785 - RNA, 1701 nt, Artificial Sequence
  hemagglutinin__InfluenzaA__ALE31752
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggggacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43786 - RNA, 1701 nt, Artificial Sequence
  hemagglutinin__InfluenzaA__ALE31753
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43787 - RNA, 1701 nt, Artificial Sequence; identical to SEQ ID NO: 43660
  hemagglutinin__InfluenzaA__ALE31754

SEQ ID NO: 43788 - RNA, 1701 nt, Artificial Sequence
  hemagglutinin__InfluenzaA__ALE31755
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccaaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43789 - RNA, 1701 nt, Artificial Sequence; identical to SEQ ID NO: 43783
  hemagglutinin__InfluenzaA__ALE31756

SEQ ID NO: 43790 - RNA, 1701 nt, Artificial Sequence; identical to SEQ ID NO: 43498
  hemagglutinin__InfluenzaA__ALE31757

SEQ ID NO: 43791 - RNA, 1701 nt, Artificial Sequence
  hemagglutinin__InfluenzaA__ALE31758
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagauccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaguugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacccugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43792 - RNA, 1701 nt, Artificial Sequence
  hemagglutinin__InfluenzaA__ALE31759
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggaaaaaacugcacucuaauagaugcacuauugggagacccucagugugauggcuuucaaaauaagagaugggaccuuuuuguugaacgaagcaaagccuacagcaacuguuacccuuaugaugugccggauuaugccucccuuaggucacuaguugccucauccggcacacuggaguuuaacgaugaaagcuucaauugggcuggagucacucaaaacggaacaaguucugcuugcauaaggggaucuaauaguaguuucuuuaguagauuaaacugguugacccacucaaacuucaaauacccagcauugaacgugacuaugccaaacaaugaacaauuugacaaauuguacauuugggggguucaccacccggguacagacaaggaccaaaucuuccuguaugcucaaucaucaggaagagucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaaucgcuccuagggguuacuucaaaauacaaagugggaaaagcucaauaaugagaucagaugcacccauuggcaaaugcaagucugaaugcaucacuccaaauggaagcauucccaauaacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43793 - RNA, 1701 nt, Artificial Sequence
  hemagglutinin__InfluenzaA__ALE31760
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugagcaauuugacaaauuguacauuugggggguucaccacccggguacggacaaggaccaaaucuuccuguaugcucaaucaucaggaagaauaacaguaucuaccaaaagaagccaacaagcuguaaucccaaauaucggauauagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugagugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacgcuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43794 - RNA, 1701 nt, Artificial Sequence; identical to SEQ ID NO: 43786
  hemagglutinin__InfluenzaA__ALE31761

SEQ ID NO: 43795 - RNA, 1701 nt, Artificial Sequence; identical to SEQ ID NO: 43607
  hemagglutinin__InfluenzaA__ALE31762

SEQ ID NO: 43796 - RNA, 1701 nt, Artificial Sequence; identical to SEQ ID NO: 43551
  hemagglutinin__InfluenzaA__ALE31763

SEQ ID NO: 43797 - RNA, 1701 nt, Artificial Sequence
  hemagglutinin__InfluenzaA__ALE31764
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuagaucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauccccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuauuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43798 - RNA, 1701 nt, Artificial Sequence; identical to SEQ ID NO: 43607
  hemagglutinin__InfluenzaA__ALE31765

SEQ ID NO: 43799 - RNA, 1701 nt, Artificial Sequence
  hemagglutinin__InfluenzaA__ALE31774
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaagucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43800 - RNA, 1701 nt, Artificial Sequence
  hemagglutinin__InfluenzaA__ALE31775
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggaguuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43801 - RNA, 1701 nt, Artificial Sequence
  hemagglutinin__InfluenzaA__ALE31776
augaagacuaucauugcuuugagcuacauucuaugucugguuuucgcucaaaagcuuccugaaaaugacaauagcacggcaacgcugugccuugggcaccaugcagugccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcauccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43802 - RNA, 1701 nt, Artificial Sequence
  hemagglutinin__InfluenzaA__ALE31777
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguagucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43803 - RNA, 1701 nt, Artificial Sequence
  hemagglutinin__InfluenzaA__ALE31778
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacuaagugggaaaagcucaauaaugagaucagaugcacccauuggcaaaugcaagucugaaugcaucacuccaaauggaagcauucccaaugacaaaccauuccaaaauguaaacaggaucacauacggggccuguccuagauauguuaagcauagcacucugaaauuggcaacaggaaugcgaaauguaccagagaaacaaacuagaggcauauuuggcgcaauagcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43804 - RNA, 1701 nt, Artificial Sequence; identical to SEQ ID NO: 43660
  hemagglutinin__InfluenzaA__ALE31779

SEQ ID NO: 43805 - RNA, 1701 nt, Artificial Sequence
  hemagglutinin__InfluenzaA__ALE31780
augaagacuaucauugcuuugagcuacauucuaugucugguuuucgcucaaaaaauuccgggaaaugacaauagcacggcaacgcugugccuugggcaccaugcaguaccaaacggaacgauagugaaaacaaucacaaaugaccgaauugaaguuacuaaugccacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaacagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcgggcuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43806 - RNA, 1701 nt, Artificial Sequence
  hemagglutinin__InfluenzaA__ALE31781
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcggcaguccucaucagauccucgauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguaaauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43807 - RNA, 1701 nt, Artificial Sequence
  hemagglutinin__InfluenzaA__ALE31782
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugucucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcagagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaagacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43808 - RNA, 1701 nt, Artificial Sequence
  hemagglutinin__InfluenzaA__ALE31783
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacgcuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacugugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacaggaaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43809 - RNA, 1701 nt, Artificial Sequence; identical to SEQ ID NO: 43561
  hemagglutinin__InfluenzaA__ALE31784

SEQ ID NO: 43810 - RNA, 1701 nt, Artificial Sequence; identical to SEQ ID NO: 43667
  hemagglutinin__InfluenzaA__ALE31785

SEQ ID NO: 43811 - RNA, 1701 nt, Artificial Sequence
  hemagglutinin__InfluenzaA__ALE31786
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagacuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacuaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43812 - RNA, 1701 nt, Artificial Sequence
  hemagglutinin__InfluenzaA__ALE31787
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguccagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43813 - RNA, 1701 nt, Artificial Sequence
  hemagglutinin__InfluenzaA__ALE31788
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaaguaucuauuggacaauaguaaaaccgggagacauacuuuugaucaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaagccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43814 - RNA, 1701 nt, Artificial Sequence; identical to SEQ ID NO: 43729
  hemagglutinin__InfluenzaA__ALE31789

SEQ ID NO: 43815 - RNA, 1701 nt, Artificial Sequence
  hemagglutinin__InfluenzaA__ALE31790
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacaguaacuguuacccuuaugaugugccggauuaugccucccuuaggucacuaguugccucauccggcacacuggaguuuaacaaugaaagcuucaauuggacuggagucacucaaaacggaacaaguucugccugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43816 - RNA, 1701 nt, Artificial Sequence
  hemagglutinin__InfluenzaA__ALE31791
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcacagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucagggagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuucagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43817 - RNA, 1701 nt, Artificial Sequence
  hemagglutinin__InfluenzaA__ALE31792
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacauauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43818 - RNA, 1701 nt, Artificial Sequence
  hemagglutinin__InfluenzaA__ALE31793
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucucccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43819 - RNA, 1701 nt, Artificial Sequence
  hemagglutinin__InfluenzaA__ALE31794
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43820 - RNA, 1701 nt, Artificial Sequence; identical to SEQ ID NO: 43498
  hemagglutinin__InfluenzaA__ALE31795

SEQ ID NO: 43821 - RNA, 1701 nt, Artificial Sequence; identical to SEQ ID NO: 43500
  hemagglutinin__InfluenzaA__ALE31796

SEQ ID NO: 43822 - RNA, 1701 nt, Artificial Sequence
  hemagglutinin__InfluenzaA__ALE31797
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacacaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuaggggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugauaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43823 - RNA, 1701 nt, Artificial Sequence; identical to SEQ ID NO: 43632
  hemagglutinin__InfluenzaA__ALE31798

SEQ ID NO: 43824 - RNA, 1701 nt, Artificial Sequence; identical to SEQ ID NO: 43523
  hemagglutinin__InfluenzaA__ALE31799

SEQ ID NO: 43825 - RNA, 1701 nt, Artificial Sequence; identical to SEQ ID NO: 43551
  hemagglutinin__InfluenzaA__ALE31800

SEQ ID NO: 43826 - RNA, 1701 nt, Artificial Sequence; identical to SEQ ID NO: 43498
  hemagglutinin__InfluenzaA__ALE31801

SEQ ID NO: 43827 - RNA, 1701 nt, Artificial Sequence
  hemagglutinin__InfluenzaA__ALE31802
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43828 - RNA, 1701 nt, Artificial Sequence; identical to SEQ ID NO: 43551
  hemagglutinin__InfluenzaA__ALE31803

SEQ ID NO: 43829 - RNA, 1701 nt, Artificial Sequence
  hemagglutinin__InfluenzaA__ALE31805
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauauccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguaugguuucaggcaucagaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43830 - RNA, 1701 nt, Artificial Sequence
  hemagglutinin__InfluenzaA__ALE31806
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugauguaccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacacacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43831 - RNA, 1701 nt, Artificial Sequence
  hemagglutinin__InfluenzaA__ALE31807
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuucacauacccagcauugaacgugacuaugccaaacaaugaacaauuugacaaauuguacguuugggggguucaccacccggguacggacaaggaccaaaucuuccuguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacagaaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43832 - RNA, 1701 nt, Artificial Sequence
  hemagglutinin__InfluenzaA__ALE31808
augaagacuaucauugcuuugggcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucauaagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43833 - RNA, 1701 nt, Artificial Sequence
  hemagglutinin__InfluenzaA__ALE31810
augaagacuaucauugcuuugagcuacauucuaugucugguuuucgcccaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacguaacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaaccgacucagaaaugaacaaacuguuugaaaaaacaaagaagcaacugagggaaaaugcugaggauaugggaaaugguuguuucaaaauauaccacaaaugugacaaugccugcauaggaucaauaaggaauggaacuuaugaccacaauguguacagggaugaagcauuaaacaaccgguuccaaaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43834 - RNA, 1701 nt, Artificial Sequence
  hemagglutinin__InfluenzaA__ALE31812
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuucaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43835 - RNA, 1701 nt, Artificial Sequence
  hemagglutinin__InfluenzaA__ALE31814
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaacaagaaaugggaccuuuuuguugaacgaagcaaagcccacagcaacuguuaccccuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaccaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcaccuauuggcaaaugcaagucugaaugcaucacuccaaauggaagcauucccaaugacaaaccauuccaaaauguaaacaggaucacauacggggccugucccagauauguuaagcaaagcacucuaaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcggcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43836 - RNA, 1701 nt, Artificial Sequence; identical to SEQ ID NO: 43835
  hemagglutinin__InfluenzaA__ALE31815

SEQ ID NO: 43837 - RNA, 1701 nt, Artificial Sequence; identical to SEQ ID NO: 43498
  hemagglutinin__InfluenzaA__ALE31818

SEQ ID NO: 43838 - RNA, 1701 nt, Artificial Sequence
  hemagglutinin__InfluenzaA__ALE31819
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggggaucuaguaguaguuucuuuaguagauuaaauugguugacccacuuaaacuacacauacccagcauugaacgugacuaugccaaacaaggaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43839 - RNA, 1701 nt, Artificial Sequence
  hemagglutinin__InfluenzaA__ALE31820
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaucacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagagaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43840 - RNA, 1701 nt, Artificial Sequence
  hemagglutinin__InfluenzaA__ALE31821
augaagacuaucauugcuuugagcuacacucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaauugcacacuaauagaugcucuauugggagacccucagugugauggcuuucaaaauaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaacgaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuacuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcauuacuccaaaugggagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauagggucaauaagaaauggaacuuaugaccacaauguguacagggaugaagcauuaaacaaucgguuccagaucaagggaguugagcugaaaucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43841 - RNA, 1701 nt, Artificial Sequence; identical to SEQ ID NO: 43650
  hemagglutinin__InfluenzaA__ALE31822

SEQ ID NO: 43842 - RNA, 1701 nt, Artificial Sequence; identical to SEQ ID NO: 43839
  hemagglutinin__InfluenzaA__ALE31823

SEQ ID NO: 43843 - RNA, 1701 nt, Artificial Sequence
  hemagglutinin__InfluenzaA__ALE31824
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43844 - RNA, 1701 nt, Artificial Sequence
  hemagglutinin__InfluenzaA__ALE31825
augaagaccaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacagauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43845 - RNA, 1701 nt, Artificial Sequence
  hemagglutinin__InfluenzaA__ALE31826
augaagacuaucauugccuugagcuacauucuaugucugguuuucgcucaaaaaaucccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43846 - RNA, 1701 nt, Artificial Sequence; identical to SEQ ID NO: 43498
  hemagglutinin__InfluenzaA__ALE31827

SEQ ID NO: 43847 - RNA, 1701 nt, Artificial Sequence
  hemagglutinin__InfluenzaA__ALE31828
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagauccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43848 - RNA, 1701 nt, Artificial Sequence
  hemagglutinin__InfluenzaA__ALE31829
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggauccaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43849 - RNA, 1701 nt, Artificial Sequence
  hemagglutinin__InfluenzaA__ALE31830
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaggccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugauauaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43850 - RNA, 1701 nt, Artificial Sequence
  hemagglutinin__InfluenzaA__ALE31832
augaagaauaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaauaguaguuucuuuaguagauuaaauugguugacccacuuaaacuacacauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43851 - RNA, 1701 nt, Artificial Sequence
  hemagglutinin__InfluenzaA__ALE31833
augaagacuaucauugccuugagcuacauucuaugucugguuuccgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcaacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43852 - RNA, 1701 nt, Artificial Sequence
  hemagglutinin__InfluenzaA__ALE31834
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugaacugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaucaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaauagcacagggaaucuaauugcuccuagggguuacuucaaaauacgaagugggaaaagcucaauaaugagaucagaugcacccauuggcaaaugcaagucugagugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcagcugagagaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43853 - RNA, 1701 nt, Artificial Sequence
  hemagglutinin__InfluenzaA__ALE31835
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaauggaacaaguucugcuugcauaaggaaaucuaguaguaguuucuuuaguagauuaaauugguugacccacuuaaacuacacauacccagcauugaacgugacuaugccaaacaacgaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaaacaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43854 - RNA, 1701 nt, Artificial Sequence
  hemagglutinin__InfluenzaA__ALE31836
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaaguuucaauuggacuggagucacucaaaacggaacaaguucugcuugcauaaggagaucuaguaguaguuucuuuaguagauuaaauugguugacccaccuaaacuacacauacccagcauugaacgugaccaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43855 - RNA, 1701 nt, Artificial Sequence
  hemagglutinin__InfluenzaA__ALE31837
augaagacuaucauugcuuugagcuacauucuaugucugguuuacgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugagcaauuugacaaauuguacauuugggggguucaccacccggguacggacaaggaccaaaucuuccuguaugcucaaucaucaggaagaauaacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugagugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaauugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43856 - RNA, 1701 nt, Artificial Sequence
  hemagglutinin__InfluenzaA__ALE31838
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggggacauacuuuugauuaacagcacagggaaucuaauugcuccuagggguuacuucaaaauacggagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43857 - RNA, 1701 nt, Artificial Sequence
  hemagglutinin__InfluenzaA__ALE31839
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgccauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43858 - RNA, 1701 nt, Artificial Sequence
  hemagglutinin__InfluenzaA__ALE31840
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacucagaauaagggauaucccuagcagaauaagcaucuauuggacaauaguaaaaccgggggacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43859 - RNA, 1701 nt, Artificial Sequence; identical to SEQ ID NO: 43568
  hemagglutinin__InfluenzaA__ALE31842

SEQ ID NO: 43860 - RNA, 1701 nt, Artificial Sequence
  hemagglutinin__InfluenzaA__ALE31843
augcagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacuaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43861 - RNA, 1701 nt, Artificial Sequence
  hemagglutinin__InfluenzaA__ALE31844
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugcaucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacucacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43862 - RNA, 1701 nt, Artificial Sequence
  hemagglutinin__InfluenzaA__ALE31846
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggaaaaaacugcacucuaauagaugcucuauugggagacccucagugugauggcuuucaaaauaagagaugggaccuuuuuguugaacgaagcaaagccuacagcaacuguuacccuuaugaugugccggauuaugccucccuuaggucacuaguugccucauccggcacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacagacaaggaccaaaucuuccuguacgcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43863 - RNA, 1701 nt, Artificial Sequence; identical to SEQ ID NO: 43591
  hemagglutinin__InfluenzaA__ALE31847

SEQ ID NO: 43864 - RNA, 1701 nt, Artificial Sequence; identical to SEQ ID NO: 43498
  hemagglutinin__InfluenzaA__ALE31848

SEQ ID NO: 43865 - RNA, 1701 nt, Artificial Sequence
  hemagglutinin__InfluenzaA__ALE31850
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaccaucaggaagaaucacaguaucuaccaaaagaagccaacaagcuguaaucccgaauaucggaucuagacccagaauaagggauaucccuagcagaauaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacagggucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguggcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43866 - RNA, 1701 nt, Artificial Sequence
  hemagglutinin__InfluenzaA__ALE31851
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcauagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43867 - RNA, 1701 nt, Artificial Sequence; identical to SEQ ID NO: 43491
  hemagglutinin__InfluenzaA__ALE31852

SEQ ID NO: 43868 - RNA, 1701 nt, Artificial Sequence
  hemagglutinin__InfluenzaA__ALE31853
augaagacuaucauugcuuugagcuacauucuaugucugguuuucacucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43869 - RNA, 1701 nt, Artificial Sequence
  hemagglutinin__InfluenzaA__ALE31854
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcagaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43870 - RNA, 1701 nt, Artificial Sequence; identical to SEQ ID NO: 43631
  hemagglutinin__InfluenzaA__ALE31855

SEQ ID NO: 43871 - RNA, 1701 nt, Artificial Sequence
  hemagglutinin__InfluenzaA__ALE31856
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucggaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43872 - RNA, 1701 nt, Artificial Sequence; identical to SEQ ID NO: 43607
  hemagglutinin__InfluenzaA__ALE31857

SEQ ID NO: 43873 - RNA, 1701 nt, Artificial Sequence
  hemagglutinin__InfluenzaA__ALE31858
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaaauacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaccagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43874 - RNA, 1701 nt, Artificial Sequence
  hemagglutinin__InfluenzaA__ALE31859
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugacagaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcacaaggagaucuaguaguaguuucuuuaguagauuaaauugguugacccacuuaaacuacacauacccagcauugaacgugacuaugccaaacaaugagcaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacaugcuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43875 - RNA, 1701 nt, Artificial Sequence
  hemagglutinin__InfluenzaA__ALE31860
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauagguaaaauaugcgacaguccucaucagauccuugauggagaaaacugcacacuaauagaugcucuauugggagauccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaaguggggaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43876 - RNA, 1701 nt, Artificial Sequence; identical to SEQ ID NO: 43600
  hemagglutinin__InfluenzaA__ALE31861

SEQ ID NO: 43877 - RNA, 1701 nt, Artificial Sequence
  hemagglutinin__InfluenzaA__ALE31862
augaagaugaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggaguuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43878 - RNA, 1701 nt, Artificial Sequence; identical to SEQ ID NO: 43637
  hemagglutinin__InfluenzaA__ALE31863

SEQ ID NO: 43879 - RNA, 1701 nt, Artificial Sequence; identical to SEQ ID NO: 43632
  hemagglutinin__InfluenzaA__ALE31865

SEQ ID NO: 43880 - RNA, 1701 nt, Artificial Sequence
  hemagglutinin__InfluenzaA__ALE31866
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43881 - RNA, 1701 nt, Artificial Sequence
  hemagglutinin__InfluenzaA__ALE31867
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaauggcaacauuaggugcaacauuugcauuuga

SEQ ID NO: 43882 - RNA, 1701 nt, Artificial Sequence; identical to SEQ ID NO: 43600
  hemagglutinin__InfluenzaA__ALE31868

SEQ ID NO: 43883 - RNA, 1701 nt, Artificial Sequence; identical to SEQ ID NO: 43881
  hemagglutinin__InfluenzaA__ALE31869

SEQ ID NO: 43884 - RNA, 1701 nt, Artificial Sequence; identical to SEQ ID NO: 43881
  hemagglutinin__InfluenzaA__ALE31870

SEQ ID NO: 43885 - RNA, 1701 nt, Artificial Sequence
  hemagglutinin__InfluenzaA__ALE31871
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcaacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuauuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43886 - RNA, 1701 nt, Artificial Sequence
  hemagglutinin__InfluenzaA__ALE31872
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaucaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaauugaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43887 - RNA, 1701 nt, Artificial Sequence
  hemagglutinin__InfluenzaA__ALE31873
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucaaauccuugauggagaaaacugcacacuaauagaugcucuauugggagauccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcaucggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43888 - RNA, 1701 nt, Artificial Sequence
  hemagglutinin__InfluenzaA__ALE31874
augaagacuaucauugcuuugagcuacauucuaugucugguuuucgcucaaaaacuuccuggaaaugacaauagcgcggcaacgcugugccuugggcaccaugcaguaccaaacggaacgauagugaaaacaaucacgaaugaccgaauugaaguuacuaaugcuacugaacugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaucaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaauagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcagcugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43889 - RNA, 1701 nt, Artificial Sequence; identical to SEQ ID NO: 43888
  hemagglutinin__InfluenzaA__ALE31875

SEQ ID NO: 43890 - RNA, 1701 nt, Artificial Sequence; identical to SEQ ID NO: 43888
  hemagglutinin__InfluenzaA__ALE31876

SEQ ID NO: 43891 - RNA, 1701 nt, Artificial Sequence
  hemagglutinin__InfluenzaA__ALE31877
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaauaaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43892 - RNA, 1701 nt, Artificial Sequence
  hemagglutinin__InfluenzaA__ALE31878
augaagacuaucauugcuuugagcuacauucuaugucugguuuucgcucaaaaaauuccuggaaaugacaauagcacggcaacgcugugccuugggcaccaugcaguaccaaacggaacuauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauuaaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaagagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43893 - RNA, 1701 nt, Artificial Sequence
  hemagglutinin__InfluenzaA__ALE31879
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaauaacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugagugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuauuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuuacuuuguguugcuuuguugggguucaucaugugggccugccaaaagggcaacauuaggugcaacauuugcauuuga

SEQ ID NO: 43894 - RNA, 1701 nt, Artificial Sequence; identical to SEQ ID NO: 43498
  hemagglutinin__InfluenzaA__ALE31880

SEQ ID NO: 43895 - RNA, 1701 nt, Artificial Sequence
  hemagglutinin__InfluenzaA__ALE31881
augaagacuaucauugccuugagccacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucauuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaguugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacccugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaagaguacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaauugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43896 - RNA, 1701 nt, Artificial Sequence; identical to SEQ ID NO: 43498
  hemagglutinin__InfluenzaA__ALE31882

SEQ ID NO: 43897 - RNA, 1701 nt, Artificial Sequence
  hemagglutinin__InfluenzaA__ALE31888
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuaccccuaugaugugccggauuaugccucccuuaggucacuaguugccucauccggcacacuggaguuuaacaaugaaagcuucaauuggacuggagucacucaaaacggaacaaguucugcuugcauaaggagaucuaguaguagcuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43898 - RNA, 1701 nt, Artificial Sequence; identical to SEQ ID NO: 43607
  hemagglutinin__InfluenzaA__ALE31889

SEQ ID NO: 43899 - RNA, 1701 nt, Artificial Sequence
  hemagglutinin__InfluenzaA__ALE31890
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcucccagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43900 - RNA, 1701 nt, Artificial Sequence; identical to SEQ ID NO: 43899
  hemagglutinin__InfluenzaA__ALE31891

SEQ ID NO: 43901 - RNA, 1701 nt, Artificial Sequence
  hemagglutinin__InfluenzaA__ALE31892
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43902 - RNA, 1701 nt, Artificial Sequence; identical to SEQ ID NO: 43520
  hemagglutinin__InfluenzaA__ALE31893

SEQ ID NO: 43903 - RNA, 1701 nt, Artificial Sequence
  hemagglutinin__InfluenzaA__ALE31894
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacaggaaaucuaauugcuccuagggguuacuucaaaauacuaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43904 - RNA, 1701 nt, Artificial Sequence
  hemagglutinin__InfluenzaA__ALE31895
augaagacuaucauugcuuugagcuacauucuaugucugguuuucgcucaaaaacuuccugggaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacgggacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaucaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgccauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucggaaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43905 - RNA, 1701 nt, Artificial Sequence
  hemagglutinin__InfluenzaA__ALE31896
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugauugggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43906 - RNA, 1701 nt, Artificial Sequence
  hemagglutinin__InfluenzaA__ALE31897
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuucaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43907 - RNA, 1701 nt, Artificial Sequence
  hemagglutinin__InfluenzaA__ALE31898
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagauccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcugugaucccaaauaucggaucuagacccagaauaagggauaucccuagcagaauaagcaucuauuggacaauaguaaaaccgggagacauacuuuugauuaacagcacaggaaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43908 - RNA, 1701 nt, Artificial Sequence
  hemagglutinin__InfluenzaA__ALE31899
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguaacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccuggagacauacuuuugauuaacagcacagggaaucuaauugcuccuagggguuacuucaaaauacgaagugggaaaagcucaaugaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacccaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43909 - RNA, 1701 nt, Artificial Sequence; identical to SEQ ID NO: 43551
  hemagglutinin__InfluenzaA__ALE31901

SEQ ID NO: 43910 - RNA, 1701 nt, Artificial Sequence
  hemagglutinin__InfluenzaA__ALE31902
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43911 - RNA, 1701 nt, Artificial Sequence
  hemagglutinin__InfluenzaA__ALE31903
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccagauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43912 - RNA, 1701 nt, Artificial Sequence
  hemagglutinin__InfluenzaA__ALE31904
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaucacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43913 - RNA, 1701 nt, Artificial Sequence
  hemagglutinin__InfluenzaA__ALE31905
augaagacuaucauugcuuugggcuacauucuaugucuggguuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucauaagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43914 - RNA, 1701 nt, Artificial Sequence
  hemagglutinin__InfluenzaA__ALE31906
augaagacuaucauugcuuugagcuacauucuaugucugguuuucgcccaaaaaauuccuggaaaugacaauagcacggcaacgcugugccuugggcaccacgcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacguaacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaaggaauggaacuuaugaccacaauguguacagggaugaagcauuaaacaaccgguuccaaaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43915 - RNA, 1701 nt, Artificial Sequence
  hemagglutinin__InfluenzaA__ALE31907
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagauccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaucgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43916 - RNA, 1701 nt, Artificial Sequence
  hemagglutinin__InfluenzaA__ALE31908
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucuuaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43917 - RNA, 1701 nt, Artificial Sequence
  hemagglutinin__InfluenzaA__ALE31909
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagauccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaucgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43918 - RNA, 1701 nt, Artificial Sequence; identical to SEQ ID NO: 43916
  hemagglutinin__InfluenzaA__ALE31910

SEQ ID NO: 43919 - RNA, 1701 nt, Artificial Sequence
  hemagglutinin__InfluenzaA__ALE31912
augaagacuaucauugcuuugagcuacauucuaugucugguuuucacucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccccaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagauuaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43920 - RNA, 1701 nt, Artificial Sequence
  hemagglutinin__InfluenzaA__ALE31913
augaagacuaucauugcuuugggcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucauaagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauagaaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43921 - RNA, 1701 nt, Artificial Sequence; identical to SEQ ID NO: 43557
  hemagglutinin__InfluenzaA__ALE31914

SEQ ID NO: 43922 - RNA, 1701 nt, Artificial Sequence
  hemagglutinin__InfluenzaA__ALE31915
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggaauaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcugugaucccaaauaucggaucuagacccagaauaagggauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43923 - RNA, 1701 nt, Artificial Sequence
  hemagglutinin__InfluenzaA__ALE31916
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauaguacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggaaaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43924 - RNA, 1701 nt, Artificial Sequence; identical to SEQ ID NO: 43923
  hemagglutinin__InfluenzaA__ALE31917

SEQ ID NO: 43925 - RNA, 1701 nt, Artificial Sequence
  hemagglutinin__InfluenzaA__ALE31918
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggaaaaaacugcacucuaauagaugcucuauugggagacccucagugugauggcuuucaaaauaagagaugggaccuuuuuguugaacgaagcaaagccuacagcaacuguuacccuuaugaugugccggauuaugccucccuuaggucgcuaguugccucauccggcacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacagacaaggaccaaaucuuccuguacgcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43926 - RNA, 1701 nt, Artificial Sequence
  hemagglutinin__InfluenzaA__ALE31920
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguucaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43927 - RNA, 1701 nt, Artificial Sequence
  hemagglutinin__InfluenzaA__ALE31921
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggcucaauaagaaauggaacuuaugaccacaauguguacagggaugaagcauuaaauaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43928 - RNA, 1701 nt, Artificial Sequence; identical to SEQ ID NO: 43520
  hemagglutinin__InfluenzaA__ALE31922

SEQ ID NO: 43929 - RNA, 1701 nt, Artificial Sequence; identical to SEQ ID NO: 43491
  hemagglutinin__InfluenzaA__ALE31923

SEQ ID NO: 43930 - RNA, 1701 nt, Artificial Sequence; identical to SEQ ID NO: 43607
  hemagglutinin__InfluenzaA__ALE31924

SEQ ID NO: 43931 - RNA, 1701 nt, Artificial Sequence; identical to SEQ ID NO: 43520
  hemagglutinin__InfluenzaA__ALE31925

SEQ ID NO: 43932 - RNA, 1701 nt, Artificial Sequence
  hemagglutinin__InfluenzaA__ALE31926
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaggcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcauauauuggacaauagugaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaucuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43933 - RNA, 1701 nt, Artificial Sequence
  hemagglutinin__InfluenzaA__ALE31927
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccucuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43934 - RNA, 1701 nt, Artificial Sequence
  hemagglutinin__InfluenzaA__ALE31928
augaagacuaucauugcuuugagcuacauucuaugucugguuuucgcucaaaaacuuccuggaaaugacaauagcacggcaacgcugugccuugggcaccaugcaguaccaaauggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucaaugugauggcuuucaaaauaagaaaugggaccuuuuuguugaacggagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccgaacaaugaacaauuugacaaauuguacauuuggggaguucaccacccggguacggacaaggaccaaaucuuccuguaugcucaaucgucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaccuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacguacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaagacacaaaaauagaucucuggucauacaacgcagagcuucuuguugcccuggagaaccaacauacaauugaucuaacugacucagaaaugaacaaacuguuugaaaaaacaaagaaacaacugagggaaaaugcugaggauaugggcaaugguuguuucaaaauauaccacaaaugugacaaugccugcauaggaucaaucagaaauggaacuuaugaccacgauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43935 - RNA, 1701 nt, Artificial Sequence
  hemagglutinin__InfluenzaA__ALE31930
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacauauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43936 - RNA, 1701 nt, Artificial Sequence; identical to SEQ ID NO: 43568
  hemagglutinin__InfluenzaA__ALE31931

SEQ ID NO: 43937 - RNA, 1701 nt, Artificial Sequence
  hemagglutinin__InfluenzaA__ALE31932
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaccucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43938 - RNA, 1701 nt, Artificial Sequence
  hemagglutinin__InfluenzaA__ALE31933
augaagacuaucauugcuuugagcuacauucuaugucugguuuacgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaaauacacauacccagcauugaacgugacuaugccaaacaaugagcaauuugacaaauuguacauuugggggguucaccacccggguacggacaaggaccaaaucuuccuguaugcucaaucaucaggaagaauaacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugagugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaauugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43939 - RNA, 1701 nt, Artificial Sequence
  hemagglutinin__InfluenzaA__ALE31934
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauaccaagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauauaccagagaaacaaacuagaggcauauuuggcgcaauagcggguuucauagaaaaugguugggagggaaugguggaugguugguacgguuucaggcaucaaaauucugaggggagaggacaagcagcagaccucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43940 - RNA, 1701 nt, Artificial Sequence
  hemagglutinin__InfluenzaA__ALE31935
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacuaagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43941 - RNA, 1701 nt, Artificial Sequence; identical to SEQ ID NO: 43727
  hemagglutinin__InfluenzaA__ALE31936

SEQ ID NO: 43942 - RNA, 1701 nt, Artificial Sequence
  hemagglutinin__InfluenzaA__ALE31937
augaagacuaucauugcuuugagcuacauucuaugucugguuuucgcucaaaaacuuccugaaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaccaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43943 - RNA, 1701 nt, Artificial Sequence
  hemagglutinin__InfluenzaA__ALE31938
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccauccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauaguacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43944 - RNA, 1701 nt, Artificial Sequence
  hemagglutinin__InfluenzaA__ALE31939
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauucuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacuaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43945 - RNA, 1701 nt, Artificial Sequence
  hemagglutinin__InfluenzaA__ALE31941
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggggacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43946 - RNA, 1701 nt, Artificial Sequence
  hemagglutinin__InfluenzaA__ALE31943
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugaaggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcacuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43947 - RNA, 1701 nt, Artificial Sequence
  hemagglutinin__InfluenzaA__ALE31944
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugaaggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcacuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43948 - RNA, 1701 nt, Artificial Sequence
  hemagglutinin__InfluenzaA__ALE31945
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucaaugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaaugucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaccagauugaaaaagaauucucagaaguagaaggaagaauucaggacauugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43949 - RNA, 1701 nt, Artificial Sequence; identical to SEQ ID NO: 43632
  hemagglutinin__InfluenzaA__ALE31946

SEQ ID NO: 43950 - RNA, 1701 nt, Artificial Sequence; identical to SEQ ID NO: 43637
  hemagglutinin__InfluenzaA__ALE31947

SEQ ID NO: 43951 - RNA, 1701 nt, Artificial Sequence
  hemagglutinin__InfluenzaA__ALE31948
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauuggucgggaaaaccaacgagaaauuccaucagauugaaaaagaauucucagaaguagaaggaagaauucaggaccuugagaaauauguugaggacacuaaaauagaucucuggucauacaacgcggaguuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43952 - RNA, 1701 nt, Artificial Sequence; identical to SEQ ID NO: 43632
  hemagglutinin__InfluenzaA__ALE31949

SEQ ID NO: 43953 - RNA, 1701 nt, Artificial Sequence
  hemagglutinin__InfluenzaA__ALE31950
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcacaguacucugaaauuggcaacaggaaugcgaaauguaccagagaaacaaacuagaggcauauuuggcgcgauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggaaaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43954 - RNA, 1701 nt, Artificial Sequence
  hemagglutinin__InfluenzaA__ALE31951
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaaguaucuauuggacaauaguaaaaccgggagacauacuuuugauuaacaguacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43955 - RNA, 1701 nt, Artificial Sequence
  hemagglutinin__InfluenzaA__ALE31952
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugagcaauuugacaaauuguacauuugggggguucaccacccggguacggacaaggaccaaaucuuccuguaugcucaaucaucaggaagaauaacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugagugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaacgggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43956 - RNA, 1701 nt, Artificial Sequence
  hemagglutinin__InfluenzaA__ALE31953
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccagguacggacaaggaccaaaucuuccuguuugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaccagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43957 - RNA, 1701 nt, Artificial Sequence
  hemagglutinin__InfluenzaA__ALE31954
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagagaugggaccuuuuuguugaacgaagcaaagccuacagcaacuguuacccuuaugaugugccggauuaugccucccuuaggucacuaguugccucauccggcacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacagacaaggaccaaaucuuccuguaugcucacucaucaggaagaaucacaguaucuaccaaaagaagccaacaagcuguaaucccgaaugucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauuggucgggaaaaccaacgagaaauuccaucagauugaaaaagaauucucagaaguagaagggagaauucaggaccuugagaaauauguugaggacacaaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacuauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43958 - RNA, 1701 nt, Artificial Sequence
  hemagglutinin__InfluenzaA__ALE31955
augaagacuaucauugccuugagcuacauucuaugucugguuuucgcucaaaaaauuccuggaaaugacaauaguacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43959 - RNA, 1701 nt, Artificial Sequence
  hemagglutinin__InfluenzaA__ALE31956
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcaacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggacaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43960 - RNA, 1701 nt, Artificial Sequence
  hemagglutinin__InfluenzaA__ALE31957
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuagauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacuaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43961 - RNA, 1701 nt, Artificial Sequence
  hemagglutinin__InfluenzaA__ALE31958
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuaaacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43962 - RNA, 1701 nt, Artificial Sequence
  hemagglutinin__InfluenzaA__ALE31959
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacgcauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43963 - RNA, 1701 nt, Artificial Sequence
  hemagglutinin__InfluenzaA__ALE31960
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcuaguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaauugaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcucuguguugcuuuguugggguucaucaugugggccugccaaaagggcaacauuaggugcaacauuugcauuuga

SEQ ID NO: 43964 - RNA, 1701 nt, Artificial Sequence
  hemagglutinin__InfluenzaA__ALE31961
augaagacuaucauugcuuugagcuacauucuaugucugguuuucgcucaaaaacuuccuggaaaugacaauagcacggcaacgcugugccuugggcaccaugcaguaccaaauggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucauugugauggcuuucaaaauaagaaaugggaccuuuuuguugaacggagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuuggggaguucaccacccggguacggacaaggaccaaaucuuccuguaugcucaaucgucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacaggaaaccuaauugcuccuagggguuacuucaaaauacgaagugggaaaagcucaauaaugagaucagaugcacccauuggcaaaugcaagucagaaugcaucacuccaaauggaagcauucccaaugacaaaccauuccaaaauguaaacaggaucacauacggggccugucccagauauguuaaacaaagcacucugaaauuggcaacaggaaugcgaaacguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaaacaacugagggaaaaugcugaggauaugggcaaugguuguuucaaaauauaccacaaaugugacaaugccugcauaggaucaaucagaaauggaacuuaugaccacgauguguacagggaugaagcauuaaacaaccgauuccagaucaagggaguugagcugaagucaggguacaaagauuggaucuuauggauuuccuuugccauaucauguuuuuugcuuuguguugcuuuguugggguucaucaugugggccugccaaaagggcaacauuaggugcaacauuugcauuuga

SEQ ID NO: 43965 - RNA, 1701 nt, Artificial Sequence
  hemagglutinin__InfluenzaA__ALE31962
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugagcaauuugacaaauuguacauuugggggguucaccacccggguacggacaaggaccaaaucuuccuguaugcucaaucaucaggaagaauaacaguaucuaccaaaagaagccaacaagcuguaaucccaaauaucggaucuagacccagaauaagggauaucccuagcagaaugagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugagugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuauuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43966 - RNA, 1701 nt, Artificial Sequence
  hemagglutinin__InfluenzaA__ALE31963
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauauccagcauugaacgugacuaugccaaacaaugaacaauuugacaaauuguacauuugggggguucaccacccggguacggacaaggaccaaaccuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuauaaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuagaugcaacauuugcauuuga

SEQ ID NO: 43967 - RNA, 1701 nt, Artificial Sequence
  hemagglutinin__InfluenzaA__ALE31964
augaagacuaucauugcuuugagcuacauucuaugucugguuuucgcucaaaaaauuccuggaaaugacaauagcacggcaacgcugugccuugggcaucaugcaguaccaaacggaacgauagugaaaacaaucacaaacgaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuauuaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43968 - RNA, 1701 nt, Artificial Sequence
  hemagglutinin__InfluenzaA__ALE31965
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaaguaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43969 - RNA, 1701 nt, Artificial Sequence; identical to SEQ ID NO: 43797
  hemagglutinin__InfluenzaA__ALE31966

SEQ ID NO: 43970 - RNA, 1701 nt, Artificial Sequence
  hemagglutinin__InfluenzaA__ALE31967
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccucuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaaauacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43971 - RNA, 1701 nt, Artificial Sequence; identical to SEQ ID NO: 43786
  hemagglutinin__InfluenzaA__ALE31968

SEQ ID NO: 43972 - RNA, 1701 nt, Artificial Sequence
  hemagglutinin__InfluenzaA__ALE31969
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccggauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggggacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggaacuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43973 - RNA, 1701 nt, Artificial Sequence; identical to SEQ ID NO: 43906
  hemagglutinin__InfluenzaA__ALE31970

SEQ ID NO: 43974 - RNA, 1701 nt, Artificial Sequence
  hemagglutinin__InfluenzaA__ALE31971
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacgcauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43975 - RNA, 1701 nt, Artificial Sequence; identical to SEQ ID NO: 43786
  hemagglutinin__InfluenzaA__ALE31972

SEQ ID NO: 43976 - RNA, 1701 nt, Artificial Sequence
  hemagglutinin__InfluenzaA__ALE31973
augaagacuaucauugccuugagcuacauucuaugucugguuuucgcucaaaaaauuccuggaaaugacaauagcacggcaacgcugugccuugggcaccaugcaguaccaaacggaacgauugugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43977 - RNA, 1701 nt, Artificial Sequence; identical to SEQ ID NO: 43964
  hemagglutinin__InfluenzaA__ALE31974

SEQ ID NO: 43978 - RNA, 1701 nt, Artificial Sequence; identical to SEQ ID NO: 43783
  hemagglutinin__InfluenzaA__ALE31975

SEQ ID NO: 43979 - RNA, 1701 nt, Artificial Sequence
  hemagglutinin__InfluenzaA__ALE31976
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuaa

SEQ ID NO: 43980 - RNA, 1701 nt, Artificial Sequence; identical to SEQ ID NO: 43498
  hemagglutinin__InfluenzaA__ALE31977

SEQ ID NO: 43981 - RNA, 1701 nt, Artificial Sequence
  hemagglutinin__InfluenzaA__ALE31978
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauucacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43982 - RNA, 1701 nt, Artificial Sequence; identical to SEQ ID NO: 43667
  hemagglutinin__InfluenzaA__ALE31979

SEQ ID NO: 43983 - RNA, 1701 nt, Artificial Sequence
  hemagglutinin__InfluenzaA__ALE31980
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauaugucaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucagaguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43984 - RNA, 1701 nt, Artificial Sequence; identical to SEQ ID NO: 43607
  hemagglutinin__InfluenzaA__ALE31981

SEQ ID NO: 43985 - RNA, 1701 nt, Artificial Sequence
  hemagglutinin__InfluenzaA__ALE31995
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucauuaguugccucauccggcacacuggaguucaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacagaaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauuuucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaacggaacuuaugaccacaauguguacagggaugaagcauuaaacaaccgguuccagaucaagggaauugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43986 - RNA, 1701 nt, Artificial Sequence
  hemagglutinin__InfluenzaA__ALE31996
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccccagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacagggucacauacggggccugucccagauauguuaaacauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43987 - RNA, 1701 nt, Artificial Sequence
  hemagglutinin__InfluenzaA__ALE31997
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuauugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucgggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43988 - RNA, 1701 nt, Artificial Sequence
  hemagglutinin__InfluenzaA__ALE31998
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuagaucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauauuggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcuccauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43989 - RNA, 1701 nt, Artificial Sequence
  hemagglutinin__InfluenzaA__ALE31999
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaauggaacaaguucugcuugcauaaggagaucuaguaguaguuucuuuagcagauuaaauugguugacccacuuacacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucuaaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaauugaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43990 - RNA, 1701 nt, Artificial Sequence
  hemagglutinin__InfluenzaA__ALE32000
augaagacuaucauugcuuugagccacauucuaugucugguuuucgcucaaaagcuuccugaaaaugacaauagcacggcaacgcugugccuugggcaccaugcaguaccaaacggaacgauagugaaaacaaucacgagugacagaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcugcaaucgaucaaaucaauggaaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43991 - RNA, 1701 nt, Artificial Sequence
  hemagglutinin__InfluenzaA__ALE32001
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaacaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 43992 - RNA, 1701 nt, Artificial Sequence
  hemagglutinin__InfluenzaA__ALE32002
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcgcccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43993 - RNA, 1701 nt, Artificial Sequence; identical to SEQ ID NO: 43813
  hemagglutinin__InfluenzaA__ALE32003

SEQ ID NO: 43994 - RNA, 1701 nt, Artificial Sequence; identical to SEQ ID NO: 43535
  hemagglutinin__InfluenzaA__ALE32004

SEQ ID NO: 43995 - RNA, 1701 nt, Artificial Sequence; identical to SEQ ID NO: 43535
  hemagglutinin__InfluenzaA__ALE32005

SEQ ID NO: 43996 - RNA, 1701 nt, Artificial Sequence; identical to SEQ ID NO: 43629
  hemagglutinin__InfluenzaA__ALE32006

SEQ ID NO: 43997 - RNA, 1701 nt, Artificial Sequence
  hemagglutinin__InfluenzaA__ALE32007
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaacuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 43998 - RNA, 1701 nt, Artificial Sequence; identical to SEQ ID NO: 43496
  hemagglutinin__InfluenzaA__ALE32008

SEQ ID NO: 43999 - RNA, 1701 nt, Artificial Sequence
  hemagglutinin__InfluenzaA__ALE32009
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauuguucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaagagggcaacauuaggugcaacauuugcauuuga

SEQ ID NO: 44000 - RNA, 1701 nt, Artificial Sequence
  hemagglutinin__InfluenzaA__ALE32010
augaagacuaucauugcuuugagcuacauucuaugucuggcuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuacacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuucaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucugaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44001 - RNA, 1701 nt, Artificial Sequence
  hemagglutinin__InfluenzaA__ALE32011
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcaacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucagaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44002 - RNA, 1701 nt, Artificial Sequence; identical to SEQ ID NO: 43510
  hemagglutinin__InfluenzaA__ALE32012

SEQ ID NO: 44003 - RNA, 1701 nt, Artificial Sequence; identical to SEQ ID NO: 43498
  hemagglutinin__InfluenzaA__ALE32013

SEQ ID NO: 44004 - RNA, 1701 nt, Artificial Sequence
  hemagglutinin__InfluenzaA__ALE32014
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuacgccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccaauuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucugacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44005 - RNA, 1701 nt, Artificial Sequence
  hemagglutinin__InfluenzaA__ALE32015
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugauguaccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacacacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44006 - RNA, 1701 nt, Artificial Sequence
  hemagglutinin__InfluenzaA__ALE32016
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaauuccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcggaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44007 - RNA, 1701 nt, Artificial Sequence; identical to SEQ ID NO: 44006
  hemagglutinin__InfluenzaA__ALE32017

SEQ ID NO: 44008 - RNA, 1701 nt, Artificial Sequence; identical to SEQ ID NO: 43568
  hemagglutinin__InfluenzaA__ALE32018

SEQ ID NO: 44009 - RNA, 1701 nt, Artificial Sequence
  hemagglutinin__InfluenzaA__ALE32020
augaagacuaucauugccuugagcuacauucuaugucugguuuucgcucaaaaaauuccuggaaaugacaauagcacggcaacgcugugccuugggcaccaugcaguaccaaauggaacgauagugaaaacaaucacaaaugaccggauugaaguuacuaaugcuacugagcugguucagaauuccucaauaggugaaauaugcgacaguccucaucagauccuugauggagaaaacugcacacuaauagaugcucuauugggagauccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44010 - RNA, 1701 nt, Artificial Sequence
  hemagglutinin__InfluenzaA__ALE32021
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuaggcccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44011 - RNA, 1701 nt, Artificial Sequence
  hemagglutinin__InfluenzaA__ALE32022
augaagacuaucauugcuuugagcuacauucuaugucugguuuucgcucaaaaaauuccuggaaaugacaauagcacggcaacgcugugccuugggcaccaugcaguaccgaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugagcaauuugacaaauuguacauuugggggguucaccacccggguacggacaaggaccaaaucuuccuguaugcucaaucaucaggaagaauaacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugagugcaucacuccaaauggaagcauucccaauggcaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuauuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44012 - RNA, 1701 nt, Artificial Sequence
  hemagglutinin__InfluenzaA__ALE32023
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuaggcccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44013 - RNA, 1701 nt, Artificial Sequence
  hemagglutinin__InfluenzaA__ALE32024
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagagaugggaccuuuuuguugaacggagcaaagccuacagcaacuguuacccuuaugaugugccggauuaugccucccuuaggucacuaguugccucauccggcacacuggaguuuaacgaugaaagcuucaauugggcuggagucacucaaaacggaaaaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacagacaaggaccaaaucuuccuguaugcucacucaucaggaagaaucacaguaucuaccaaaagaagccaacaagcuguaaucccgaauaucggaucuagacccaggauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaagucugaaugcaucacuccaaauggaagcauucccaaugacaaaccauuccaaaauguaaacaggaucacauacgggaccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacuauguauacagggaugaagcuuuaaacaaccguuuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44014 - RNA, 1701 nt, Artificial Sequence
  hemagglutinin__InfluenzaA__ALE32025
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaucgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugagcaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44015 - RNA, 1701 nt, Artificial Sequence; identical to SEQ ID NO: 43607
  hemagglutinin__InfluenzaA__ALE32026

SEQ ID NO: 44016 - RNA, 1701 nt, Artificial Sequence; identical to SEQ ID NO: 43491
  hemagglutinin__InfluenzaA__ALE32027

SEQ ID NO: 44017 - RNA, 1701 nt, Artificial Sequence
  hemagglutinin__InfluenzaA__ALE32028
augaagacuaucauugcuuugagccacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44018 - RNA, 1701 nt, Artificial Sequence
  hemagglutinin__InfluenzaA__ALE32029
augaagacuaucauugcuuugagcuacauucuaugucugguuuucgcccaaaaaauuccuggaaaugacaauagcacggcaacgcugugccuugggcaccacgcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacguaacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaaggaauggaacuuaugaccacaauguguacagggaugaagcauuaaacaaccgguuccaaaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44019 - RNA, 1701 nt, Artificial Sequence
  hemagglutinin__InfluenzaA__ALE32030
augaagacuaucauugcuuugagccacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacauauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44020 - RNA, 1701 nt, Artificial Sequence
  hemagglutinin__InfluenzaA__ALE32031
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacuguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauaguacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44021 - RNA, 1701 nt, Artificial Sequence
  hemagglutinin__InfluenzaA__ALE32032
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucgcuguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44022 - RNA, 1701 nt, Artificial Sequence; identical to SEQ ID NO: 43916
  hemagglutinin__InfluenzaA__ALE32033

SEQ ID NO: 44023 - RNA, 1701 nt, Artificial Sequence
  hemagglutinin__InfluenzaA__ALE32034
augaagacuaucauugcuuugggcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaacugguucagaauuccucaauaggugaaauaugcgacaguccucauaagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaaauacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44024 - RNA, 1701 nt, Artificial Sequence
  hemagglutinin__InfluenzaA__ALE32035
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaacaagaaaugggaccuuuuuguugaacgaagcaaagcccacagcaacuguuaccccuaugaugugccggauuaugccucccuuaggucacuaguugccucaucuggcacacuggaguuuaacaaugaaagcuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaccaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcaccuauuggcaaaugcaagucugaaugcaucacuccaaauggaagcauucccaaugacaaaccauuccaaaauguaaacaggaucacauacggggccugucccagauauguuaagcaaagcacucuaaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcggcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44025 - RNA, 1701 nt, Artificial Sequence
  hemagglutinin__InfluenzaA__ALE32036
augaagacuaucauugcuuugggcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaacugguucagaauuccucaauaggugaaauaugcgacaguccucauaagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuacacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44026 - RNA, 1701 nt, Artificial Sequence
  hemagglutinin__InfluenzaA__ALE32037
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacuaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44027 - RNA, 1701 nt, Artificial Sequence
  hemagglutinin__InfluenzaA__ALE32038
augaagacaaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugagcaauuugacaaauuguacauuugggggguucaccacccggguacggacaaggaccaaaucuuccuguaugcucaaucaucaggaagaauaacaguaucuaccaaaagaagccaacaagcuguaaucccaaauaucggaucuaggcccagaauaagggauaucccuagcagaauaagcaucuauuggacaauaguaaaaccgggagacauacuuuugauuaacagcaaagggaaucuaauugcuccuagggguuacuucaaaauacgaagugggaaaagcucaauaaugagaucagaugcacccauuggcaaaugcaagucugagugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucuaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44028 - RNA, 1701 nt, Artificial Sequence; identical to SEQ ID NO: 43632
  hemagglutinin__InfluenzaA__ALE32039

SEQ ID NO: 44029 - RNA, 1701 nt, Artificial Sequence
  hemagglutinin__InfluenzaA__ALE32040
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccugguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggacaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauugaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44030 - RNA, 1701 nt, Artificial Sequence
  hemagglutinin__InfluenzaA__ALE32041
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagauccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugagagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44031 - RNA, 1701 nt, Artificial Sequence; identical to SEQ ID NO: 43498
  hemagglutinin__InfluenzaA__ALE32042

SEQ ID NO: 44032 - RNA, 1701 nt, Artificial Sequence
  hemagglutinin__InfluenzaA__ALE32043
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagauccucagugugauggcuuucaaaauaagaaaugggaccuuuuuguugaacgaagcaaagccuacagcaacuguuacccuuaugaugugccggauuauaccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuagagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44033 - RNA, 1701 nt, Artificial Sequence
  hemagglutinin__InfluenzaA__ALE32044
augaagacuaucauugcuuugagcuacauucuaugucugguuuucgcucaaaaaauuccugggaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugauaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44034 - RNA, 1701 nt, Artificial Sequence
  hemagglutinin__InfluenzaA__ALE32045
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaacgaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaacucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44035 - RNA, 1701 nt, Artificial Sequence; identical to SEQ ID NO: 44033
  hemagglutinin__InfluenzaA__ALE32046

SEQ ID NO: 44036 - RNA, 1701 nt, Artificial Sequence
  hemagglutinin__InfluenzaA__ALE32047
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagguccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugauaucagaugcacccauuggcaaaugcaagucugaaugcaucacuccaaauggaagcauucccagugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44037 - RNA, 1701 nt, Artificial Sequence; identical to SEQ ID NO: 44034
  hemagglutinin__InfluenzaA__ALE32048

SEQ ID NO: 44038 - RNA, 1701 nt, Artificial Sequence
  hemagglutinin__InfluenzaA__ALE32049
augaagacuaucauugcuuuaagcuacauucuaugucugguuuucgcucaaaaaauuccuggaaaugacaauagcacggcaacacugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgaaaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuauuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44039 - RNA, 1701 nt, Artificial Sequence
  hemagglutinin__InfluenzaA__ALE32050
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaagacggaacaaguucugcuugcauaaggagaucuaguaguaguuucuuuaguagauuaaauugguugacccacuuaaacuacacauacccagcauugaacgugacuaugccaaacaaugagcaauuugacaaauuguacauuugggggguucaccacccggguacggacaaggaccaaaucuuccuguaugcucaaucaucaggaagaauaacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugagugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44040 - RNA, 1701 nt, Artificial Sequence
  hemagglutinin__InfluenzaA__ALE32051
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacagggucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaauuaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44041 - RNA, 1701 nt, Artificial Sequence
  hemagglutinin__InfluenzaA__ALE32052
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggggaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacguuacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuagaugcaacauuugcauuuga

SEQ ID NO: 44042 - RNA, 1701 nt, Artificial Sequence
  hemagglutinin__InfluenzaA__ALE32053
augaagacuaucauugcuuugagcuacauucuaugucugguuuucgcucaaaaaauuccuggaaaugacaauagcacggcaacgcugugccuugggcaccaugcaguaccaaacggaacuauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaagagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44043 - RNA, 1701 nt, Artificial Sequence
  hemagglutinin__InfluenzaA__ALE32054
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgaaaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaaccauugcauuuga

SEQ ID NO: 44044 - RNA, 1701 nt, Artificial Sequence
  hemagglutinin__InfluenzaA__ALE32055
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcauuguugggguucaucaugugggccugccaaaauggcaacauuaggugcaacauuugcauuuga

SEQ ID NO: 44045 - RNA, 1701 nt, Artificial Sequence
  hemagglutinin__InfluenzaA__ALE32056
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcccuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44046 - RNA, 1701 nt, Artificial Sequence
  hemagglutinin__InfluenzaA__ALE32057
augaagacuaucauugcuuugagcuacguucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44047 - RNA, 1701 nt, Artificial Sequence; identical to SEQ ID NO: 43520
  hemagglutinin__InfluenzaA__ALE32058

SEQ ID NO: 44048 - RNA, 1701 nt, Artificial Sequence; identical to SEQ ID NO: 43520
  hemagglutinin__InfluenzaA__ALE32059

SEQ ID NO: 44049 - RNA, 1701 nt, Artificial Sequence
  hemagglutinin__InfluenzaA__ALE32060
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaagucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauucacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaauaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44050 - RNA, 1701 nt, Artificial Sequence
  hemagglutinin__InfluenzaA__ALE32061
augaagaccaucauugcccugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaaauacacauacccagcauugaacgugacuaugccaaacaaugaacaauuugacaaauuguacauuugggggguucaccacccggguacggacaaugaccaaaucuuccuguaugcucgaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacgggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44051 - RNA, 1701 nt, Artificial Sequence
  hemagglutinin__InfluenzaA__ALE32062
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacucuugauuuacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggaaaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44052 - RNA, 1701 nt, Artificial Sequence; identical to SEQ ID NO: 43535
  hemagglutinin__InfluenzaA__ALE32063

SEQ ID NO: 44053 - RNA, 1701 nt, Artificial Sequence
  hemagglutinin__InfluenzaA__ALE32064
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaauaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauauaggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44054 - RNA, 1701 nt, Artificial Sequence; identical to SEQ ID NO: 43525
  hemagglutinin__InfluenzaA__ALE32065

SEQ ID NO: 44055 - RNA, 1701 nt, Artificial Sequence
  hemagglutinin__InfluenzaA__ALE32066
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugucuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44056 - RNA, 1701 nt, Artificial Sequence; identical to SEQ ID NO: 43727
  hemagglutinin__InfluenzaA__ALE32067

SEQ ID NO: 44057 - RNA, 1701 nt, Artificial Sequence
  hemagglutinin__InfluenzaA__ALE32068
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaaacauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucucguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44058 - RNA, 1701 nt, Artificial Sequence
  hemagglutinin__InfluenzaA__ALE32069
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44059 - RNA, 1701 nt, Artificial Sequence
  hemagglutinin__InfluenzaA__ALE32070
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggucugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaauaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44060 - RNA, 1701 nt, Artificial Sequence
  hemagglutinin__InfluenzaA__ALE32071
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucagacaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44061 - RNA, 1701 nt, Artificial Sequence; identical to SEQ ID NO: 43942
  hemagglutinin__InfluenzaA__ALE32072

SEQ ID NO: 44062 - RNA, 1701 nt, Artificial Sequence
  hemagglutinin__InfluenzaA__ALE32073
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacuaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44063 - RNA, 1701 nt, Artificial Sequence
  hemagglutinin__InfluenzaA__ALE32074
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucuucuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacuaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44064 - RNA, 1701 nt, Artificial Sequence
  hemagglutinin__InfluenzaA__ALE32075
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucuucuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucugacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44065 - RNA, 1701 nt, Artificial Sequence; identical to SEQ ID NO: 43527
  hemagglutinin__InfluenzaA__ALE32076

SEQ ID NO: 44066 - RNA, 1701 nt, Artificial Sequence
  hemagglutinin__InfluenzaA__ALE32077
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccauccggguacggacaaggaccaaaucuuccuguaugcucgaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44067 - RNA, 1701 nt, Artificial Sequence
  hemagglutinin__InfluenzaA__ALE32078
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaucacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44068 - RNA, 1701 nt, Artificial Sequence
  hemagglutinin__InfluenzaA__ALE32079
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagagaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44069 - RNA, 1701 nt, Artificial Sequence
  hemagglutinin__InfluenzaA__ALE32080
augaagacuaucauugcuuugagcuacauucuaugucugguuuucgcucaaaaaauuccuggaaaugacaauagcacggcaacgcugugccuuggacaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugcuucccuuaggucacugguugccucauccggcacacuggaguuuaacaaugaaagcuucaauuggacuggagucacucaaaacggaacaaguucuucuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44070 - RNA, 1701 nt, Artificial Sequence
  hemagglutinin__InfluenzaA__ALE32081
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaaguuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44071 - RNA, 1701 nt, Artificial Sequence; identical to SEQ ID NO: 43632
  hemagglutinin__InfluenzaA__ALE32082

SEQ ID NO: 44072 - RNA, 1701 nt, Artificial Sequence
  hemagglutinin__InfluenzaA__ALE32083
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44073 - RNA, 1701 nt, Artificial Sequence
  hemagglutinin__InfluenzaA__ALE32084
augaagaccaucauugcccugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacgggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugccuuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaaaucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44074 - RNA, 1701 nt, Artificial Sequence
  hemagglutinin__InfluenzaA__ALE32085
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaacgaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44075 - RNA, 1701 nt, Artificial Sequence
  hemagglutinin__InfluenzaA__ALE32086
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuagcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44076 - RNA, 1701 nt, Artificial Sequence
  hemagglutinin__InfluenzaA__ALE32087
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugacggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuagacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaauuuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaaucugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44077 - RNA, 1701 nt, Artificial Sequence
  hemagglutinin__InfluenzaA__ALE32088
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucuccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaguugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44078 - RNA, 1701 nt, Artificial Sequence; identical to SEQ ID NO: 43568
  hemagglutinin__InfluenzaA__ALE32089

SEQ ID NO: 44079 - RNA, 1701 nt, Artificial Sequence; identical to SEQ ID NO: 43498
  hemagglutinin__InfluenzaA__ALE32090

SEQ ID NO: 44080 - RNA, 1701 nt, Artificial Sequence
  hemagglutinin__InfluenzaA__ALE32091
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaaggaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44081 - RNA, 1701 nt, Artificial Sequence
  hemagglutinin__InfluenzaA__ALE32092
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucaaauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaggucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaacacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44082 - RNA, 1701 nt, Artificial Sequence; identical to SEQ ID NO: 43551
  hemagglutinin__InfluenzaA__ALE32093

SEQ ID NO: 44083 - RNA, 1701 nt, Artificial Sequence
  hemagglutinin__InfluenzaA__ALE32094
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaccagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44084 - RNA, 1701 nt, Artificial Sequence; identical to SEQ ID NO: 43607
  hemagglutinin__InfluenzaA__ALE32095

SEQ ID NO: 44085 - RNA, 1701 nt, Artificial Sequence
  hemagglutinin__InfluenzaA__ALE32096
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaagcuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44086 - RNA, 1701 nt, Artificial Sequence; identical to SEQ ID NO: 43607
  hemagglutinin__InfluenzaA__ALE32097

SEQ ID NO: 44087 - RNA, 1701 nt, Artificial Sequence; identical to SEQ ID NO: 43551
  hemagglutinin__InfluenzaA__ALE32099

SEQ ID NO: 44088 - RNA, 1701 nt, Artificial Sequence
  hemagglutinin__InfluenzaA__ALE32100
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggaucuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 44089 - RNA, 1701 nt, Artificial Sequence
  hemagglutinin__InfluenzaA__ALE32101
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagccaauguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuagugguaguuucuuuaguagauuaaauugguugacccacuuaaaauacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44090 - RNA, 1701 nt, Artificial Sequence
  hemagglutinin__InfluenzaA__ALE32102
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaaauacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaagcaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44091 - RNA, 1701 nt, Artificial Sequence; identical to SEQ ID NO: 43658
  hemagglutinin__InfluenzaA__ALE32103

SEQ ID NO: 44092 - RNA, 1701 nt, Artificial Sequence
  hemagglutinin__InfluenzaA__ALE32104
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccaaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44093 - RNA, 1701 nt, Artificial Sequence; identical to SEQ ID NO: 43632
  hemagglutinin__InfluenzaA__ALE32105

SEQ ID NO: 44094 - RNA, 1701 nt, Artificial Sequence; identical to SEQ ID NO: 43637
  hemagglutinin__InfluenzaA__ALE32106

SEQ ID NO: 44095 - RNA, 1701 nt, Artificial Sequence; identical to SEQ ID NO: 43658
  hemagglutinin__InfluenzaA__ALE32107

SEQ ID NO: 44096 - RNA, 1701 nt, Artificial Sequence; identical to SEQ ID NO: 43888
  hemagglutinin__InfluenzaA__ALE32108

SEQ ID NO: 44097 - RNA, 1701 nt, Artificial Sequence; identical to SEQ ID NO: 43510
  hemagglutinin__InfluenzaA__ALE32109

SEQ ID NO: 44098 - RNA, 1701 nt, Artificial Sequence
  hemagglutinin__InfluenzaA__ALE32110
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaggaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaaucgauugaucgggaaaaccaaugagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44099 - RNA, 1701 nt, Artificial Sequence
  hemagglutinin__InfluenzaA__ALE32111
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauaguacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44100 - RNA, 1701 nt, Artificial Sequence
  hemagglutinin__InfluenzaA__ALE32112
augaagacuaucauugcuuugagcuacauucuaugucugguuuucgcucaaaaaauuccugggaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacgcguacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44101 - RNA, 1701 nt, Artificial Sequence
  hemagglutinin__InfluenzaA__ALE32113
augaagacuaucauugcuuugagcuacauucuaugucugguuuucgcucaaaaaauuccuggaaaugacaauagcacggcaacgcugugccuugggcaccaugcaguaccaaacggaacgguagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaaaaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggggaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaaugcgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44102 - RNA, 1701 nt, Artificial Sequence; identical to SEQ ID NO: 43786
  hemagglutinin__InfluenzaA__ALE32114

SEQ ID NO: 44103 - RNA, 1701 nt, Artificial Sequence; identical to SEQ ID NO: 43783
  hemagglutinin__InfluenzaA__ALE32115

SEQ ID NO: 44104 - RNA, 1701 nt, Artificial Sequence
  hemagglutinin__InfluenzaA__ALE32116
augaagacuaucauugcuuugagcuacauucuaugucugguuuucgcucaaaaaauuccuggaaaugacaauagcacggcaacgcugugccuugggcaucaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacguuaggugcaacauuugcauuuga

SEQ ID NO: 44105 - RNA, 1701 nt, Artificial Sequence
  hemagglutinin__InfluenzaA__ALE32117
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauaugucaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagauuucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucagaguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44106 - RNA, 1701 nt, Artificial Sequence; identical to SEQ ID NO: 43551
  hemagglutinin__InfluenzaA__ALE32118

SEQ ID NO: 44107 - RNA, 1701 nt, Artificial Sequence; identical to SEQ ID NO: 34493
  hemagglutinin__InfluenzaA__ALM06086

SEQ ID NO: 44108 - RNA, 1701 nt, Artificial Sequence
  hemagglutinin__InfluenzaA__ALM06087
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacauccaguucagacaauggaacguguuacccaggagauuucaucaauuaugaggagcuaagggagcaauugagcucagugucaucauuugagagauuugagauauuccccaagacaaguucauggcccaaucaugacucgaacaaagguguaacggcagcauguccucacgcuggggcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauugggaaauguccaaaguauguaaaaagcacaaaauugagacuggccacaggauugaggaaugucccaucuauucaaucuagaggccuauucggggcgauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggagaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaauuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 44109 - RNA, 1701 nt, Artificial Sequence
  hemagglutinin__InfluenzaA__ALM06088
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagggagcaauugagcucagugucaucauuugagagauuugagauauuccccaagacaaguucauggcccaaucaugacucgaacaaagguguaacggcagcauguccucacgcuggggcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauugggaaauguccaaaguauguaaaaagcacaaaauugagacuggccacaggauugaggaaugucccaucuauucaaucuagaggccuauucggggcgauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggagaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 44110 - RNA, 1701 nt, Artificial Sequence
  hemagglutinin__InfluenzaA__ALM06089
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguugccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagggagcaauugagcucagugucaucauuugagagauuugagauauuccccaagacaaguucauggcccaaucaugacucgaacaaagguguaacggcagcauguccucacgcuggggcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauugggaaauguccaaaguauguaaaaagcacaaaauugagacuggccacaggauugaggaaugucccaucuauucaaucuagaggccuauucggggcgauugccggcuucauugaagggggguggacagggaugguagauggaugguacgguuaucaccaucaaaaugagcaggggucaggauaugcagccgaccugaagagcacacaaaaugccauugacaaaauuacuaacaaaguaaauucuguuauugaaaagaugaauacacaguucacagcaguggguaaagaguucaaccacuuggagaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 44111 - RNA, 1701 nt, Artificial Sequence
  hemagglutinin__InfluenzaA__ALN39661
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccccaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccauccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauaggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguauugcuuuguugggguucaucaugugggccugccaaaagggcaacauuaggugcaacauuugcauuuga

SEQ ID NO: 44112 - RNA, 1701 nt, Artificial Sequence
  hemagglutinin__InfluenzaA__ALN39662
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggaaaaaacugcacucuaauagaugcucuauugggagacccucagugugauggcuuucaaaauaagagaugggaccuuuuuguugaacgaagcaaagccuacagcaacuguuacccuuaugaugugccggauuaugccucccuuaggucacuaguugccucauccggcacacuggaguuuaacgaugaaagcuucaauugggcuggagucacucaaaacggaacaaguucugcuugcauaaggggaucuaauaguaguuucuuuaguagguuaaauugguugacccacucaaacuucaaauacccagcauugaacgugacuaugccaaacaaugaacaauuugacaaauuguacauuugggggguucaccacccggguacagacaaggaccaaaucuuccuguacgcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccauaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44113 - RNA, 1701 nt, Artificial Sequence
  hemagglutinin__InfluenzaA__ALN39663
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuaccaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaacgggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44114 - RNA, 1701 nt, Artificial Sequence
  hemagglutinin__InfluenzaA__ALN39664
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguauauuugggggguucaccacccggguacggacaaggaccaaaucuuccuguaugcacaaccaucaggaagagucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44115 - RNA, 1701 nt, Artificial Sequence; identical to SEQ ID NO: 43517
  hemagglutinin__InfluenzaA__ALN39665

SEQ ID NO: 44116 - RNA, 1701 nt, Artificial Sequence
  hemagglutinin__InfluenzaA__ALN39666
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaaguaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacuaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacagggaugcgaaauguaccagagaaacaaacuagaggcauauuuggcgcaauagcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44117 - RNA, 1701 nt, Artificial Sequence
  hemagglutinin__InfluenzaA__ALN39667
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcaacagcccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaccccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaagccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaacgggaagcugaaucgauugaucgggaaaaccaacgagaaauuccaucagauugaaaaagaauucucagaaguagaaggaagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacguaugaccacgauguauacaggaaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44118 - RNA, 1701 nt, Artificial Sequence
  hemagglutinin__InfluenzaA__ALN39668
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44119 - RNA, 1701 nt, Artificial Sequence
  hemagglutinin__InfluenzaA__ALN39669
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaauuaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44120 - RNA, 1701 nt, Artificial Sequence
  hemagglutinin__InfluenzaA__ALN39670
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaauggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44121 - RNA, 1701 nt, Artificial Sequence
  hemagglutinin__InfluenzaA__ALN39671
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaggaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44122 - RNA, 1701 nt, Artificial Sequence; identical to SEQ ID NO: 43568
  hemagglutinin__InfluenzaA__ALN39672

SEQ ID NO: 44123 - RNA, 1701 nt, Artificial Sequence
  hemagglutinin__InfluenzaA__ALN39673
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccagauaucggaucuagacccagaauaagggauaucccuagcagaauaagcaucuauuggacaauaguaaaaccgggagacauacuuuugauuaacagcacagggaauuuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44124 - RNA, 1701 nt, Artificial Sequence
  hemagglutinin__InfluenzaA__ALN39674
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucgcuaguugccucauccggcacacuggaguucaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaacggaacuuaugaccacaauguguacagggaugaagcauuaaacaaccgguuccagaucaagggaauugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44125 - RNA, 1701 nt, Artificial Sequence; identical to SEQ ID NO: 43498
  hemagglutinin__InfluenzaA__ALN39675

SEQ ID NO: 44126 - RNA, 1701 nt, Artificial Sequence
  hemagglutinin__InfluenzaA__ALN39676
augaagacuaucauugcuuugagcugcauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaaacuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaucaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucagaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaaucagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44127 - RNA, 1701 nt, Artificial Sequence
  hemagglutinin__InfluenzaA__ALN39677
augaagacuaucauugcuuugggcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucauaagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacgcauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44128 - RNA, 1701 nt, Artificial Sequence
  hemagglutinin__InfluenzaA__ALN39678
augaagacuaucauugcuuugggcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaacugguucagaauuccucaauaggugaaauaugcgacaguccucauaagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44129 - RNA, 1701 nt, Artificial Sequence
  hemagglutinin__InfluenzaA__ALN39679
augaagacuaucauugcuuugggcuacauucuaugucugguuuucgcucaaaaaauuccuggaaaugacaauagcacggcaacgcugugccuugggcaccaugcaguaccaaacggaacgguagugaaaacaaucacaaaugaccgaauugaaguuacuaaugcuacugagcugguucagaauuccucaauaggugaaauaugcgacaguccucauaagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucgaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44130 - RNA, 1701 nt, Artificial Sequence; identical to SEQ ID NO: 44128
  hemagglutinin__InfluenzaA__ALN39680

SEQ ID NO: 44131 - RNA, 1701 nt, Artificial Sequence; identical to SEQ ID NO: 44128
  hemagglutinin__InfluenzaA__ALN39681

SEQ ID NO: 44132 - RNA, 1701 nt, Artificial Sequence; identical to SEQ ID NO: 44128
  hemagglutinin__InfluenzaA__ALN39682

SEQ ID NO: 44133 - RNA, 1701 nt, Artificial Sequence; identical to SEQ ID NO: 44128
  hemagglutinin__InfluenzaA__ALN39683

SEQ ID NO: 44134 - RNA, 1701 nt, Artificial Sequence; identical to SEQ ID NO: 44128
  hemagglutinin__InfluenzaA__ALN39684

SEQ ID NO: 44135 - RNA, 1701 nt, Artificial Sequence; identical to SEQ ID NO: 44128
  hemagglutinin__InfluenzaA__ALN39685

SEQ ID NO: 44136 - RNA, 1701 nt, Artificial Sequence
  hemagglutinin__InfluenzaA__ALN39686
augaagacuaucauugcuuugggcuacauucuaugucuggcuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucauaagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuauaccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44137 - RNA, 1701 nt, Artificial Sequence; identical to SEQ ID NO: 44128
  hemagglutinin__InfluenzaA__ALN39687

SEQ ID NO: 44138 - RNA, 1701 nt, Artificial Sequence
  hemagglutinin__InfluenzaA__ALN39688
augaagacuaucauugcuuugggcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucauaagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggggucacucaaaacggaacaaguucugcuugcauaaggagaucuaguaguaguuucuuuaguagauuaaauugguugacccacuuaaacuacauauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaaucagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44139 - RNA, 1701 nt, Artificial Sequence
  hemagglutinin__InfluenzaA__ALN39689
augaagacuaucauugcuuugggcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaacugguucagaauuccucaauaggugaaauaugcgacaguccucauaagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauucacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44140 - RNA, 1701 nt, Artificial Sequence
  hemagglutinin__InfluenzaA__ALN39690
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaacaagaaaugggaccuuuuuguugaacgaagcaaagcccacagcaacuguuaccccuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuccauauacccagcauuaaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcaccuauuggcaaaugcaagucugaaugcaucacuccaaauggaagcauucccaaugacaaaccauuccaaaauguaaacaggaucacauacggggccugucccagauauguuaagcaaagcacucuaaaauuggcaacaggaaugcgaaauguaccagagagacaaacuagaggcauauuuggcgcaauagcggguuucauagaaaaugguugggagggaaugguggaugguugguacgguuucaggcaucaaaauucugagggaagaggacaagcggcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaaucagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44141 - RNA, 1701 nt, Artificial Sequence
  hemagglutinin__InfluenzaA__ALN39691
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaacaagaaaugggaccuuuuuguugaacgaagcaaagcccacagcaacuguuaccccuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaccaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcaccuauuggcaaaugcaagucugaaugcaucacuccaaauggaagcauucccaaugacaaaccauuccaaaauguaaacaggaucacauacggggccugucccagauauguuaagcaaagcacucuaaaauuggcaacaggaaugcgaaauguaccagagaaacaaacuagaggcauauuuggcgcaauagcggguuucauagaaaaugguugggagggaaugaaggaugguugguacggcuucaggcaucaaaauucugagggaagaggacaagcggcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44142 - RNA, 1701 nt, Artificial Sequence
  hemagglutinin__InfluenzaA__ALN39692
augaagacuaucauugcuuugggcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaacugguucagaauuccucaauaggugaaauaugcgacaguccucauaagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucagacaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44143 - RNA, 1701 nt, Artificial Sequence; identical to SEQ ID NO: 44128
  hemagglutinin__InfluenzaA__ALN39693

SEQ ID NO: 44144 - RNA, 1701 nt, Artificial Sequence; identical to SEQ ID NO: 44128
  hemagglutinin__InfluenzaA__ALN39694

SEQ ID NO: 44145 - RNA, 1701 nt, Artificial Sequence; identical to SEQ ID NO: 44128
  hemagglutinin__InfluenzaA__ALN39695

SEQ ID NO: 44146 - RNA, 1701 nt, Artificial Sequence; identical to SEQ ID NO: 44128
  hemagglutinin__InfluenzaA__ALN39696

SEQ ID NO: 44147 - RNA, 1701 nt, Artificial Sequence
  hemagglutinin__InfluenzaA__ALN39697
augaagacuaucauugcuuugagcuacauucuaugucugguuuucgcucaaaagcuuccugaaaaugacaauagcacggcaacgcugugccuugggcaccaugcaguaccaaacggaacgauagugaaaacaaucacgagugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccgguacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcacugaacgugacuaugccaaacaaugaacaauuugacaaauuguacauuugggggguucaccacccggguacggacaaggaccaaaucuuccuguaugcucaaucaucaggaagaaucacaguauccaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44148 - RNA, 1701 nt, Artificial Sequence
  hemagglutinin__InfluenzaA__ALN39698
augaagacuaucauugcuuugagccacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcaugggaucaauaagaaauggaacuuaugaccacaauguguacaggaaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44149 - RNA, 1701 nt, Artificial Sequence
  hemagglutinin__InfluenzaA__ALN39700
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauauccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaagugcaacauuugcauuuga

SEQ ID NO: 44150 - RNA, 1701 nt, Artificial Sequence
  hemagglutinin__InfluenzaA__ALN39701
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuuuaaaauacuaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44151 - RNA, 1701 nt, Artificial Sequence
  hemagglutinin__InfluenzaA__ALN39702
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuauuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcagcauuugcauuuga

SEQ ID NO: 44152 - RNA, 1701 nt, Artificial Sequence
  hemagglutinin__InfluenzaA__ALN39703
augaagacuaucauugccuugagcuacauucuaugucugguuuucgcucaaaaaauuccuggaaaugacgauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44153 - RNA, 1701 nt, Artificial Sequence
  hemagglutinin__InfluenzaA__ALN39704
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccagauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaagccgggagacauacuuuugauuaacagcacagggaaucuaauugcuccuagggguuacuucaaaauacuaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44154 - RNA, 1701 nt, Artificial Sequence
  hemagglutinin__InfluenzaA__ALN39705
augaagacuaucauugcauugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44155 - RNA, 1701 nt, Artificial Sequence
  hemagglutinin__InfluenzaA__ALN39706
augaagacuaucauugcuuugagcuacauucuaugucugguuuucgcucaaaaacuuccuggaaaugacaauagcacggcaacgcugugccuugggcaccaugcaguaccaaacggaaugauagugaaaacaaucacgaaugaccgaauugaaguuacuaaugcuacugagcugguucagaauuccucaauaggugaaauaugcgacaguccucaucagauccuugauggaaaaaacugcacucuaauagaugcucuauugggagacccucagugugaugacuuucaaaauaagagaugggaccuuuuuguugaacgaagcaaagccuacagcaacuguuacccuuaugaugugccggauuaugccucccuuaggucacuaguugccucauccggcacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacagacaaggaccaaaucuuccuguacgcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44156 - RNA, 1701 nt, Artificial Sequence
  hemagglutinin__InfluenzaA__ALN39707
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44157 - RNA, 1701 nt, Artificial Sequence; identical to SEQ ID NO: 43551
  hemagglutinin__InfluenzaA__ALN39708

SEQ ID NO: 44158 - RNA, 1701 nt, Artificial Sequence
  hemagglutinin__InfluenzaA__ALN39709
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauucuucaauaggugaaauaugcgacaguccucaucagauccuugauggagaaaacugcacacuaauugaugcucuauugggagacccucagugugauggcuuucaaaacaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcaugaggggaucuaauaguaguuuuuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaucaucaggaagaaucacaguaucuaccaaaagaagccaacaagcuguaaccccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaaccuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44159 - RNA, 1701 nt, Artificial Sequence; identical to SEQ ID NO: 43875
  hemagglutinin__InfluenzaA__ALN39710

SEQ ID NO: 44160 - RNA, 1701 nt, Artificial Sequence; identical to SEQ ID NO: 43551
  hemagglutinin__InfluenzaA__ALN39711

SEQ ID NO: 44161 - RNA, 1701 nt, Artificial Sequence
  hemagglutinin__InfluenzaA__ALN39712
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44162 - RNA, 1701 nt, Artificial Sequence
  hemagglutinin__InfluenzaA__ALN39713
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggggaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggcucgauaagaaauggaacuuaugaccacaauguguacagggaugaagcauuaaauaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44163 - RNA, 1701 nt, Artificial Sequence
  hemagglutinin__InfluenzaA__ALN39714
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaccuuccuguaugcacaaccaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaacgcugaggauaugggcaaugguuguuucaaaauauaccacaaaugugacaaugccugcauaggaucaaucagaaauggaacuuaugaccacgauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44164 - RNA, 1701 nt, Artificial Sequence
  hemagglutinin__InfluenzaA__ALN39715
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaguuugacaaauuguacauuugggggguucaccacccggguacggacaaggaccaaaucuuccuguaugcucgaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44165 - RNA, 1701 nt, Artificial Sequence; identical to SEQ ID NO: 43498
  hemagglutinin__InfluenzaA__ALN39716

SEQ ID NO: 44166 - RNA, 1701 nt, Artificial Sequence
  hemagglutinin__InfluenzaA__ALN39717
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccucuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44167 - RNA, 1701 nt, Artificial Sequence
  hemagglutinin__InfluenzaA__ALN39718
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacggagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauaugucaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucagaguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44168 - RNA, 1701 nt, Artificial Sequence
  hemagglutinin__InfluenzaA__ALN39734
augaagacuaucauugccuugagcuacauucuaugccugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44169 - RNA, 1701 nt, Artificial Sequence
  hemagglutinin__InfluenzaA__ALN39735
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacagaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44170 - RNA, 1701 nt, Artificial Sequence
  hemagglutinin__InfluenzaA__ALN39736
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaauuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaccaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaggugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucagaaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44171 - RNA, 1701 nt, Artificial Sequence; identical to SEQ ID NO: 43551
  hemagglutinin__InfluenzaA__ALN39737

SEQ ID NO: 44172 - RNA, 1701 nt, Artificial Sequence
  hemagglutinin__InfluenzaA__ALN39738
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucugugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44173 - RNA, 1701 nt, Artificial Sequence
  hemagglutinin__InfluenzaA__ALN39739
augaagacuaucauugcuuugggcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaacugguucagaauuccucaauaggugaaauaugcgacaguccucauaagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuagacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44174 - RNA, 1701 nt, Artificial Sequence
  hemagglutinin__InfluenzaA__ALN39740
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacugugccaaacaaugaacaauuugacaaauuguacauuugggggguucaccacccggguacggacaaggaccaaaucuuccuguaugcucgaucaucaggaagaaucacaguaucuaccaaaagaagccaacaagcuguaaucccaaauaucggauauagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauauggggaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44175 - RNA, 1701 nt, Artificial Sequence
  hemagglutinin__InfluenzaA__ALN39741
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguuaacccacuuaaacuacacauacccagcauugaacgugacuaugccaaacaaugaacaauuugacaaauuauacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagagaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44176 - RNA, 1701 nt, Artificial Sequence
  hemagglutinin__InfluenzaA__ALN39742
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggacugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44177 - RNA, 1701 nt, Artificial Sequence
  hemagglutinin__InfluenzaA__ALN39743
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacauauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagagauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuauuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44178 - RNA, 1701 nt, Artificial Sequence
  hemagglutinin__InfluenzaA__ALN39744
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagagauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuauuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44179 - RNA, 1701 nt, Artificial Sequence
  hemagglutinin__InfluenzaA__ALN39745
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggaaaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagagauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaucaacauacaauugaucuaacugacucagaaaugaacaaacuauuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44180 - RNA, 1701 nt, Artificial Sequence; identical to SEQ ID NO: 44178
  hemagglutinin__InfluenzaA__ALN39746

SEQ ID NO: 44181 - RNA, 1701 nt, Artificial Sequence
  hemagglutinin__InfluenzaA__ALN39747
augaagacuaucauugccuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuacgccucccuuaggucacuaguugccucaucuggcacacuggaguuuaacaaugaaagcuucaauuggacuggagucacucaaaacggaacaaguucugcuugcauaaggagaucuaguaguaguuucuuuaguagauuaaauugguugacccacuuaaaauacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44182 - RNA, 1701 nt, Artificial Sequence
  hemagglutinin__InfluenzaA__ALN39748
augaagacuaucauugcuuugagcuacauucuaugucugguuuucgcucaaaaaauuccuggaaaugacaauagcacggcaacgcugugccuugggcaccaugcagugccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaagaagaucuaguaguaguuucuuuaguagauuaaauugguugacccacuuaaacuacgcauacccagcauugaacgugacuaugccaaacaaugaacaauuugacaaauuguacauuugggggguucaccacccggguacggacaaggaccaaaucuuccuguaugcucaaucaucgggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacuaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44183 - RNA, 1701 nt, Artificial Sequence
  hemagglutinin__InfluenzaA__ALN39749
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcaacaguccucaucagauccuugauggagaaaacugcacacuaauagaugcucuauugggagacccucagugugauggcuuucaaaacaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaccaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcaccuauuggcaaaugcaagucugaaugcaucacuccaaauggaagcauucccaaugacaaaccauuccaaaauguaaacaggaucacauacggggccugucccagauauguuaagcaaagcacucuaaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaaacugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuagaugcaacauuugcauuuga

SEQ ID NO: 44184 - RNA, 1701 nt, Artificial Sequence; identical to SEQ ID NO: 43498
  hemagglutinin__InfluenzaA__ALN39750

SEQ ID NO: 44185 - RNA, 1701 nt, Artificial Sequence
  hemagglutinin__InfluenzaA__ALN39789
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccuguccuagauaugucaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucaaauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44186 - RNA, 1701 nt, Artificial Sequence; identical to SEQ ID NO: 43475
  hemagglutinin__InfluenzaA__ALO75895

SEQ ID NO: 44187 - RNA, 1701 nt, Artificial Sequence
  hemagglutinin__InfluenzaA__ALO75907
auggagaaaauagugcuucuucuugcaauaguuagccuuguuaaaggugaucagauuugcauugguuaccaugcaaacaacucgacggagcagguugacacgauaauggaaaagaacgucacuguuacacaugcccaagacauacuggaaaagacacacaauggaaagcucugcgauuuaaauggagugaagccucugauuuuaaaggauuguaguguagcuggaugguuccuuggaaaccgaaugugugacgaguucaucagagugccggaauggucuuacauaguggagagggcuaacccagccaaugaccucuguuauccagggaaccucaaugacuaugaggaacugaaacaccuauugagcagaauaaaucauuuugagaagacucugaucauccccaagaguucuuggcccaaucauacaucaucaggggugagugcagcauguccauaccagggaaugcccuccuuuuucagaaaugugguauggcuuaccaaaaagaacgaugcauacccaacaauaaagaugagcuacaauaauaccuauagggaagaucuuuugauacugugggggauucaucauuccaacaaugcagcagagcagacaaaucucuauaaaaacccaaccaccuauguuuccguugggacaucaacauuaaaccagagauuggagccaaaaauagcuacuagaucccaaguaaacgggcaacguggaagaauggauuucuucuggaccauuuuaaaaccgaaugaugcaauccacuucgagaguaauggaaauuuuauugcuccagaauaugcauacaaaauugucaagaaaggggacucaacaauuaugaaaagugaaauggaauaugggcacugcaacaccaaaugucaaacuccaauaggggcgauaaacucuaguaugccauuccacaauauacacccucucacuaucggggagugccccaaauacgugaaaucgaacaaauuaguccuugcgacugggcucagaaauaguccucuaagagaaagaagaagaaaaagaggacuauuuggagcuauagcaggguuuauagagggaggauggcaaggaaugguagaugguugguauggguaccaccauagcaaugaacaggggaguggguacgcugcagacagagaauccacccaaaaggcaauagauggaguuaccaauaaggucaacucgauaauagacaaaaugaacacucaauuugaggccguuggaagagaauuuaauaacuuagaacggagaauagagaauuuaaauaagaaaauggaagacggauucuuagaugucuggacuuauaaugcugaacuuuuaguucucauggaaaaugagagaacucuagauuuccaugacucaaaugucaagaaccuuuaugacaagguccgacuacagcuuagggauaaugcaaaggagcuggguaaugguuguuucgaguucuaucacaaaugugauaaugaauguauggaaaguguaagaaaugggacguaugacuacccccuguauucagaagaagcaagguuaaaaagggaagaaauaagcggagugaaauuggaaucaauaggaacuuaccaaauacugucaaauuauucaacaguggcgaguucccuagcacuggcaaucauuguggcuggucuaucuuuauggaugugcuccaaugggucguuacaaugcagaauuugcauuuaa

SEQ ID NO: 44188 - RNA, 1701 nt, Artificial Sequence
  hemagglutinin__InfluenzaA__ALO75919
auggagaaaauagugcuucuucuugcaauaguuagccuuguuaaaggugaucagauuugcauugguuaccaugcaaacaacucgacggagcagguugacacgauaauggaaaagaacgucacuguuacacaugcccaagacauacuggaaaagacacacaauggaaagcucugcgauuuaaauggagugaagccucugauuuuaaaggauuguaguguagcuggauggcuccauggaaaccgaaugugugacgaguucaucagagugccggaauggucuuacauaguggagagggcuaacccagccaaugaccucuguuauccagggaaccucaaugacuaugaggaacugaaacaccuauugagcagaauaaaucauuuugagaagacucugaucauccccaagaguucuuggcccaaucauacaucaucaggggugagugcagcauguccauaccagggaaugcccuccuuuuucagaaaugugguauggcuuaccaaaaagaacgaugcauacccaacaauaaagaugagcuacaauaauaccuauagggaagaucuuuugauacugugggggauucaucauuccaacaaugcagcagagcagacaaaucucuauaaaaacccaaccaccuauguuuccguugggacaucaacauuaaaccagagauuggagccaaaaauagcuacuagaucccaaguaaacgggcaacguggaagaauggauuucuucuggaccauuuuaaaaccgaaugaugcaauccacuucgagaguaauggaaauuuuauugcuccagaauaugcauacaaaauugucaagaaaggggacucaacaauuaugaaaagugaaauggaauaugggcacugcaacaccaaaugucaaacuccaauaggggcgauaaacucuaguaugccauuccacaauauacacccucucacuaucggggagugccccaaauacgugaaaucgaacaaauuaguccuugcgacugggcucagaaauaguccucuaagagaaagaagaagaaaaagaggacuauuuggagcuauagcaggguuuauagagggaggauggcaaggaaugguagaugguugguauggguaccaccauagcaaugaacaggggaguggguacgcugcagacagagaauccacccaaaaggcaauagauggaguuaccaauaaggucaacucgauaauagacaaaaugaacacucaauuugaggccguuggaagagaauuuaauaacuuagaacggagaauagagaauuuaaauaagaaaauggaagacggauucuuagaugucuggacuuauaaugcugaacuuuuaguucucauggaaaaugagagaacucuagauuuccaugacucaaaugucaagaaccuuuaugacaagguccgacuacagcuuagggauaaugcaaaggagcuggguaaugguuguuucgaguucuaucacaaaugugauaaugaauguauggaaaguguaagaaaugggacguaugacuacccccuguauucagaagaagccagcuuaaaaagggaagaaauaagcggagugaaauuggaaucaauaggaacuuaccaaauacugucaauuuauucaacaguggcgaguucccuagcacuggcaaucauaguggcugguuuaucuuuauggaugugcuccaaugggucguugcagugcagaauuugcauuuaa

SEQ ID NO: 44189 - RNA, 1683 nt, Artificial Sequence
  hemagglutinin__InfluenzaA__ALT20080
auggagacaguaucacuaauaacuauacuacuaguagcaacaguaagcaaugcagauaaaaucugcaucggcuaucaaucaacaaacucuacagaaacuguggacacacuaacagaaaacaaugucccugugacacaugcaaaagaauugcuccacacagagcauaaugggaugcugugugcaacaagcuugggacaaccucuuauuuuagacaccugcaccauugaagggcuaaucuauggcaauccuucuugugaucuaucgcuggaaggaagagaaugguccuauaucgucgagagaccaucagcuguuaacggauuguguuaccccgggaauguagaaaaucuagaagagcuaaggucacuuuuuaguucugcuaggucuuaucaaagaauccagauuuucccagacacaaucuggaaugugucuuacgaugggacaagcacagcaugcucagguucauucuacagaagcaugagaugguugacucgaaagaacggcgauuacccuauccaagacgcccaauacacaaauaaucaagggaagaacauucuuuucauguggggcauaaaucacccacccaccgauacuacgcagagagaucuauacacgagaaccgacacaacaacgaguguggcaacagaagaaauaaauaggaucuucaaaccauugauaggaccaagaccucuugucaacgguuugaugggaagaauugauuauuauuggucgguuuugaaaccaggucaaacacugcgaauaaaaucugaugggaaccuaauagcuccaugguuuggacacauucuuucaggagagagccacggaagaauucugaagacuaaucuaaaaagggguagcugcaccgugcaaugucagacagagaaagguggcuuaaacacaacauugccauuccaaaauguaaguaaguaugcauuuggaaacugcucaaaauacauuggcauaaagagucucaaacuugcaguuggucugaggaaugugccuucuagaucuaguagaggacuauucggggccauagcaggguuuauagagggagguuggucaggacuagucgcugguugguauggguuccagcauucaaaugaccaagggguugguauggcagcagauagagacucaacucaaaaggcaauugauaaaauaacauccaaagugaauaauauagucgacaaaaugaacaagcaauaugaaaucaucgaucaugaauucagugagguagaaacuagacuuaacaugaucaauaauaagauugaugaucaaauccaggauauaugggcauauaaugcagaauugcuaguucugcucgaaaaccagaaaacacucgaugagcaugaugcaaauguaaacaaucuauauaauaaaguaaagagggcguuggguuccaaugcgguggaagaugggaaaggauguuucgagcuauaccacaaaugugaugaccaaugcauggagacaauucgaaacgggaccuacaacagaaggaaauaucaagaggagucaaaauuagaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 44190 - RNA, 1701 nt, Artificial Sequence
  hemagglutinin__InfluenzaA__ALT66860
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaucuucuggaagacaagcauaacggaaaacuaugcaaacuaagagggguagccccauugcauuuggguaaauguaacauugcuggcuggauccugggaaauccagagugugaaucacucuccacagcaaguucaugguccuacauuguggaaacaucuaauucagacaauggaacguguuacccaggagauuucaucaauuaugaggagcuaagagagcaauugagcucagugucaucauuugaaagguuugaaauauuccccaagacaaguucauggcccaaucaugacucgaacaaagguguaacggcagcauguccucacgcuggagcaaaaagcuucuacaaaaacuugauauggcuaguuaaaaaaggaaauucauacccaaagcucaaccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaacaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauugggaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaaucuaaauaaaaaaguugaugaugguuuccuggacauuuggacuuacaaugccgaacuguugguucuauuggaaaaugaaagaacuuuggacuaucacgauucaaaugugaagaacuuguaugaaaaaguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggaucuaccagauuuuggcgaucuauucaacugucgccaguucauugguacugguagucucccugggggcaaucagcuucuggaugugcucuaaugggucucuacaguguagaauauguauuuaa

SEQ ID NO: 44191 - RNA, 1701 nt, Artificial Sequence
  hemagglutinin__InfluenzaA__AMA65391
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuggaagacaagcauaacggaaaacuaugcaaacuaagagggguagccccauugcauuuggguaaauguaacauugcuggcuggauccugggaaauccagagugugaaucacucuccacagcaaguucaugguccuacauuguggaaacaucuaauucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaacuugauauggcuaguuaaaaaaggaaauucauacccaaagcucaaccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaacaagacccaaagugaggggucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaauguuccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaaucuaaauaaaaaaguugaugaugguuuccuggacauuuggacuuacaaugccgaacuguugguucuauuggaaaaugaaagaacuuuggacuaucacgauucaaaugugaagaacuuguaugaaaaaguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucuuccugggggcaaucagcuucuggaugugcucuaaugggucucuacaguguagaauauguauuuaa

SEQ ID NO: 44192 - RNA, 1701 nt, Artificial Sequence
  hemagglutinin__InfluenzaA__AMA65393
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaucuucuggaagacaagcauaacggaaaacuaugcaaacuaagagggguagccccauugcauuuggguaaauguaacauugcuggcuggauccugggaaauccagagugugaaucacucuccacagcaaguucaugguccuacauuguggaaacaucuaauucagacaauggaacguguuacccaggagauuucaucaauuaugaggagcuaagagagcaauugagcucagugucaucauuugaaagguuugaaauauuccccaagacaaguucauggcccaaucaugacucgaacaaagguguaacggcagcauguccucacgcuggagcaaaaagcuucuacaaaaacuugauauggcuaguuaaaaaaggaaauucauacccaaagcucaaccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaacaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauugggaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaaucuaaauaaaaaaguugaugaugguuuccuggacauuuggacuuacaaugccgaacuguugguucuauuggaaaaugaaagaacuuuggacuaucacgauucaaaugugaagaacuuguaugaaaaaguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggaucuaccagauuuuggcgaucuauucaccugucgccaguucauugguacugguagucuuccugggggcaaucagcuucuggaugugcucuaaugggucucuacaguguagaauauguauuuaa

SEQ ID NO: 44193 - RNA, 1701 nt, Artificial Sequence
  hemagglutinin__InfluenzaA__BAA02768
augaaagcaaaacuacuaguccuguuaugugcauuuacagcuacagaugcagacacaauauguauaggcuaccaugcgaacaacucaaccgacacuguugacacaguacuugagaagaacgugacagugacacacucugucaaccuacuugaggacagucacaacggaaaacuaugucgacuaaaaggaauagccccacuacaauuggguaauugcagcauugccggauggaucuuaggaaacccagaaugcgaaucacuguuuucuaaggaaucaugguccuacauugcagaaacaccaaacuccgagaauggaacauguuacccaggguauuucgccgacuaugaggaacugagggagcaauugaguucaguaucaucauucgagagauucgaaauauuccccaaagaaagcucauggcccaaccacaccguaaccaaaggaguaacggcaucaugcucccauaaugggaaaagcaguuuuuacagaaauuugcuauggcugacggggaagaauggcuuguacccaaaucugagcaaguccuaugugaacaacaaagagaaagaaguccuuguacuaugggguguucaucacccgucuaacauaggggaccaaagggccaucuaucauacagaaaaugcuuaugucucuguagugucuucacauuauagcaggagauucaccccagaaauagcaaaaagacccaaaguaagaggucaagaaggaagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucaauggaugaaugugacgcgaagugucaaacaccccagggagcuauaaacaguagucuuccuuuccagaauguacacccagucacaauaggagaguguccaaaguaugucaggaguacaaaauuaaggaugguuacaggacuaaggaacaucccauccauucaauccagagguuuguuuggagccauugccgguuucauugaagggggguggacuggaaugauagauggaugguaugguuaucaucaucagaaugaacaaggaucuggcuaugcugcggaucaaaaaagcacacaaaaugccauuaacggaauuacaaacaaggugaauucuguaaucgagaaaaugaacacucaauucacagcugugggcaaagaauucaacaaauuagaaagaaggauggaauacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggauacggguguuuugaauucuaccacaaguguaacaaugaaugcauggaaagugugaaaaauggaacuuaugacuauccaaaauauuccgaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcaguguagaauaugcaucuga

SEQ ID NO: 44194 - RNA, 1701 nt, Artificial Sequence
  hemagglutinin__InfluenzaA__BAA02769
augaaagcaaaacuacuaguccuguuaugugcauuuacagcuacagaugcagacacaauauguauaggcuaccaugcgaacaacucaaccgacacuguugacacaguacuugagaagaacgugacagugacacacucugucaaccuacuugaggacagucacaacggaaaacuaugucgacuaaaaggaauagccccacuacaauuggguaauugcagcauugccggauggaucuuaggaaacccagaaugcgaaucacuguuuucuaaggaaucaugguccuacauugcagaaacaccaaacuccgagaauggaacauguuacccaggguauuucgccgacuaugaggaacugagggagcaauugaguucaguaucaucauucgagagauucgaaauauuccccaaagaaagcucauggcccaaccacaccguaaccaaaggaguaacggcaucaugcucccauaaugggaaaagcaguuuuuacagaaauuugcuauggcugacggggaagaauggcuuguacccaaaucugagcaaguccuaugugaacaacaaagagaaagaaguccuuguacuaugggguguucaucacccgucuaacauaagggaccaaagggccaucuaucauacagaaaaugcuuaugucucuguagugucuucacauuauagcaggagauucaccccagaaauagcaaaaagacccaaaguaagagaucaagaaggaagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucaauggaugaaugugacgcgaagugucaaacaccccagggagcuauaaacaguagucuuccuuuccagaauguacacccagucacaauaggagaguguccaaaguaugucaggaguacaaaauuaaggaugguuaaaggacuaaggaacaucccauccauucaauccagagguuuguuuggagccauugccgguuucauugaagggggguggacuggaaugauagauggaugguaugguuaucaucaucagaaugaacaaggaucuggcuaugcugcggaucaaaaaagcacacaaaaugccauuaacggaauuacaaacaaggugaauucuguaaucgagaaaaugaacacucaauucacagcugugggcaaagaauucaacaaauuagaaagaaggauggaauacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggauacggguguuuugaauucuaccacaaguguaacaaugaaugcauggaaagugugaaaaauggaacuuaugacuauccaaaauauuccgaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcaguguagaauaugcaucuga

SEQ ID NO: 44195 - RNA, 1689 nt, Artificial Sequence
  hemagglutinin__InfluenzaA__BAC43764
auggccaucauuuaucucauucuccuguucacagcagugagaggggaccagauaugcauuggauaccaugccaauaauuccacagagaaggucgacacaauucuagagcggaacgucacugugacucaugccaagaacauucuugagaagacccauaacggaaaguuaugcaaacuaaacggaaucccuccacuugaacuaggggacuguagcauugccggauggcuccuuggaaauccagaaugugauaggcuucuaauugugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucgcgggccugugcggugucugguaauccaucauucuucaggaacauggucuggcugacaaagaaaggaucaaauuauccgguugccaaaggaucguacaacaauacaagcggagaacaaaugcugauaauuuggggggugcaccaucccauugaugagacagaacaaauaacauuguaccagaaugugggaaccuauguuuccguaggcacaucaacauugaacaaaaggucaaccccagaaauagcaacaaggccuaaagugaauggacuaggaaguagaauggaauucucuuggacccucuuggauaugugggacaccauaaauuuugagaguacugguaaucuaauugcaccagaguauggauucaaaauaucgaaaagagguaguucagggaucaugaaaacagaaggaacacuugagaacugugagaccaaaugccaaacuccuuugggagcaauaaauacaacauugccuuuucauaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggauaugcagcagacaaagaauccacucaaaaggcauuugauggaaucaccaacaagguaaauucugugauugaaaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauuccaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugccacaguagcagguucucugucacuggcaaucaugauggcugggaucucuuucuggaugugcuccaacgggucucugcaguucaggaucugcauauga

SEQ ID NO: 44196 - RNA, 1707 nt, Artificial Sequence
  hemagglutinin__InfluenzaA__BAE07201
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucuaauuuugagagauuguaguguagcuggauggcuccucggaaacccaaugugugacgaauucaucaaugugccggaauggucuuacauaguggagaaggccaauccagccaaugaccucuguuacccaggggauuucaacgacuaugaagaauugaaacaccuauugagcagaauaaaccauuuugagaaaauucagaucauccccaaaaauucuugguccagucaugaagccucauuaggggugagcucagcauguccauaccaaggaaaguccuccuuuuucaggaaugugguauggcuuaucaaaaagaacaaugcauacccaacaauaaagaggagcuacaauaauaccaaccaagaagaucuuuugguauugugggggauucaccauccuaaugaugcggcagagcagacuaggcucuaucaaaacccaaccaccuacauuuccguugggacaucaacacuaaaccagagauugguaccaaaaauagcuacuagauccaaaguaaacgggcaaaauggaaggauggaguucuucuggacaauuuuaaaaccgaaugaugcaaucaacuucgagagcaauggaaauuucauugcuccagaauaugcauacaaaauugucaagaaaggggacucagcaauuaugaaaagugaauuggaauaugguaacugcaacaccaagugucaaacuccaaugggggcgauaaacucuaguaugccauuccacaauauacacccucucaccaucggggaaugccccaaauaugugaaaucaaacagauuaguccuugcgacugggcucagaaauagcccucaaagagagagaagaagaaaaaagagaggauuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagagaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuggguaacgguuguuucgaguucuaucacaaaugugauaaugaauguauggaaaguguaagaaacggaacguaugacuacccgcaguauucagaagaagcaagacuaaaaagagaggaaauaaguggaguaaaauuggagucaauaggaacuuaccaaauacugucaauuuauucuacaguggcgaguucccuagcacuggcaaucaugguagcuggucuaucuuuauggaugugcuccaaugggucguuacaaugcagaauuugcauuuaa

SEQ ID NO: 44197 - RNA, 1701 nt, Artificial Sequence
  hemagglutinin__InfluenzaA__BAH95823
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaacauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuugaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44198 - RNA, 1701 nt, Artificial Sequence; identical to SEQ ID NO: 33168
  hemagglutinin__InfluenzaA__BAH95824

SEQ ID NO: 44199 - RNA, 1707 nt, Artificial Sequence
  hemagglutinin__InfluenzaA__BAJ07997
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucuaauuuugagagauuguaguguagcuggauggcuccucggaaacccaaugugugacgaauucaucaaugugccggaauggucuuacauaguggagaaggccaauccagccaaugaccucuguuacccaggggauuucaacgacuaugaagaauugaaacaccuauugagcagaauaaaccauuuugagaaaauucagaucauccccaaaaauucuugguccagucaugaagccucauuaggggugagcucagcauguccauaccaaggaaaguccuccuuuuucaggaaugugguauggcuuaucaaaaagaacaaugcauacccaacaauaaagaggagcuacaauaauaccaaccaagaagaucuuuugguauugugggggauucaccauccuaaugaugcggcagagcagacuaggcucuaucaaaacccaaccaccuacauuuccguugggacaucaacacuaaaccagagauugguaccaaaaauagcuacuagauccaaaguaaacgggcaaaguggaaggauggaguucuucuggacaauuuuaaaaccgaaugaugcaaucaacuucgagagcaauggaaauuucauugcuccagaauaugcauacaaaauugucaagaaaggggacucagcaauuaugaaaagugaauuggaauaugguaacugcaacaccaagugucaaacuccaaugggggcgauaaacucuaguaugccauuccacaauauacacccucucaccaucggggaaugccccaaauaugugaaaucaaacagauuaguccuugcgacugggcucagaaauagcccucaaagagagagaagaagaaaaaagagaggauuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagagaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuggguaacgguuguuucgaguucuaucacaaaugugauaaugaauguauggaaaguguaagaaacggaacguaugacuacccgcaguauucagaagaagcaagacuaaaaagagaggaaauaaguggaguaaaauuggagucaauaggaacuuaccaaauacugucaauuuauucuacaguggcgaguucccuagcacuggcaaucaugguagcuggucuaucuuuauggaugugcuccaaugggucguuacaaugcagaauuugcauuuaa

SEQ ID NO: 44200 - RNA, 1701 nt, Artificial Sequence
  hemagglutinin__InfluenzaA__BAJ39949
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccaaacuguugguucuauugaaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44201 - RNA, 1701 nt, Artificial Sequence
  hemagglutinin__InfluenzaA__BAJ39950
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauugcggaaacaucuaguucagacaauggaacguguuacccaggagauuucaucgauuaugaggagcuaagagagcaauugagcucagugucaucauuugaaagguuugagauauuccccaagacuaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44202 - RNA, 1701 nt, Artificial Sequence
  hemagglutinin__InfluenzaA__BAJ39951
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuuuucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44203 - RNA, 1701 nt, Artificial Sequence
  hemagglutinin__InfluenzaA__BAJ39952
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcugguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44204 - RNA, 1701 nt, Artificial Sequence
  hemagglutinin__InfluenzaA__BAJ39953
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccaaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44205 - RNA, 1701 nt, Artificial Sequence
  hemagglutinin__InfluenzaA__BAJ39954
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcugguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44206 - RNA, 1701 nt, Artificial Sequence
  hemagglutinin__InfluenzaA__BAJ39955
augaaggcaauacuaguaguucugcuauauacauuugcaaccgcaaaugcagacacauuaaguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcaggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuauuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguaaaauauguauuuaa

SEQ ID NO: 44207 - RNA, 1701 nt, Artificial Sequence
  hemagglutinin__InfluenzaA__BAJ39956
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauugcggaaacaucuaguucagacaauggaacguguuacccaggagauuucaucgauuaugaggagcuaagagagcaauugagcucagugucaucauuugaaagguuugagauauuccccaagacuaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44208 - RNA, 1701 nt, Artificial Sequence
  hemagglutinin__InfluenzaA__BAJ39957
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacuaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44209 - RNA, 1701 nt, Artificial Sequence
  hemagglutinin__InfluenzaA__BAJ39958
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuaggggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaaaaagccaguuaaaaaacaaugccaaggaaauuggaaacggcugcuuugaauuuuaccacaaaugcgauaacacgugcauggaaaguguaaaaaaugggacuuaugacuacccaaaauacucaaaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44210 - RNA, 1701 nt, Artificial Sequence
  hemagglutinin__InfluenzaA__BAJ39959
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagccauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccguuuauucaaucuaggggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaaaaagccaguuaaaaaacaaugccaaggaaauuggaaacggcugcuuugaauuuuaccacaaaugcgauaacacgugcauggaaaguguaaaaaaugggacuuaugacuacccaaaauacucaaaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44211 - RNA, 1701 nt, Artificial Sequence
  hemagglutinin__InfluenzaA__BAJ39960
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuaggggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaguguaaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44212 - RNA, 1701 nt, Artificial Sequence
  hemagglutinin__InfluenzaA__BAJ39961
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaguguaaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44213 - RNA, 1701 nt, Artificial Sequence
  hemagglutinin__InfluenzaA__BAJ39962
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauugcggaaacaucuaguucagacaauggaacguguuacccaggagauuucaucgauuaugaggagcuaagagagcaauugagcucagugucaucauuugaaagguuugagauauuccccaagacuaguucauggcccaaucaugacucgaacaaaggcguaacggcagcauguccucaugcuggagcaaaaagcuucuacaaaaauuuaacauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccguuuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaaaaagccaguuaaaaaacaaugccaaggaaauuggaaacggcugcuuugaauuuuaccacaaaugcgauaacacgugcauggaaaguguaaaaaaugggacuuaugacuacccaaaauacucaaaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44214 - RNA, 1701 nt, Artificial Sequence
  hemagglutinin__InfluenzaA__BAJ39963
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacuaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggguugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugauggguuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44215 - RNA, 1701 nt, Artificial Sequence
  hemagglutinin__InfluenzaA__BAJ39964
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44216 - RNA, 1701 nt, Artificial Sequence
  hemagglutinin__InfluenzaA__BAJ39965
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44217 - RNA, 1701 nt, Artificial Sequence
  hemagglutinin__InfluenzaA__BAJ39966
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagagguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuaggggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44218 - RNA, 1701 nt, Artificial Sequence
  hemagglutinin__InfluenzaA__BAJ39967
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaauuacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucggacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacccaguucacagcauuagguaaagaguucaaccaccuggaaaaaaaaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44219 - RNA, 1701 nt, Artificial Sequence
  hemagglutinin__InfluenzaA__BAJ39968
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgagaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaguguaaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44220 - RNA, 1701 nt, Artificial Sequence
  hemagglutinin__InfluenzaA__BAJ39969
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44221 - RNA, 1701 nt, Artificial Sequence
  hemagglutinin__InfluenzaA__BAJ39970
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44222 - RNA, 1701 nt, Artificial Sequence
  hemagglutinin__InfluenzaA__BAJ39971
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagagguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuaggggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaguguaaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44223 - RNA, 1701 nt, Artificial Sequence
  hemagglutinin__InfluenzaA__BAJ39972
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44224 - RNA, 1701 nt, Artificial Sequence
  hemagglutinin__InfluenzaA__BAJ39973
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaaaaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44225 - RNA, 1701 nt, Artificial Sequence
  hemagglutinin__InfluenzaA__BAJ39974
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuaggggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44226 - RNA, 1701 nt, Artificial Sequence
  hemagglutinin__InfluenzaA__BAJ39975
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44227 - RNA, 1701 nt, Artificial Sequence
  hemagglutinin__InfluenzaA__BAJ39976
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgagaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaguguaaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaauuucuggaugugcucuaaugggucucuacaguguagaauauguauuuaa

SEQ ID NO: 44228 - RNA, 1701 nt, Artificial Sequence
  hemagglutinin__InfluenzaA__BAJ39977
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacuaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaguguaaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44229 - RNA, 1701 nt, Artificial Sequence
  hemagglutinin__InfluenzaA__BAJ39978
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagaucuucccuaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaaaaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44230 - RNA, 1701 nt, Artificial Sequence
  hemagglutinin__InfluenzaA__BAJ39979
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaauuacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucggacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaauggacuauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaaaagcacacagaaugccauugacaagauuacuaacaaaguaaauucuguuauugaaaagaugaauacacaguucacagcaguagguaaagaguucaaccaccuggaaaauagaauagagaauuuaaauaaaaagguugaugaugguuuccuggacauuuggacuuacaaugccgaacuguugguucuauuggaaaaugaaagaacuuuggacuaccaugauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44231 - RNA, 1701 nt, Artificial Sequence; identical to SEQ ID NO: 44203
  hemagglutinin__InfluenzaA__BAJ39980

SEQ ID NO: 44232 - RNA, 1701 nt, Artificial Sequence
  hemagglutinin__InfluenzaA__BAJ39981
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuauccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguucaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaaaaagccaguuaaaaaacaaugccaaggaaauuggaaacggcugcuuugaauuuuaucacaaaugcgauaacacgugcauggaaagugucaaaaaugggacuuaugacuacccaaaauacucaaaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44233 - RNA, 1701 nt, Artificial Sequence
  hemagglutinin__InfluenzaA__BAJ39982
augaaggcaauacuaguaguucugcuauauacauuugcaaccgcaaaugcagccacauuauguauagguuaucaugcgaacaauucaacagacacuguagacacauuacuagaaaagaauguaacaguaacacacucuguuaaccuucuagaagacaagcauaacgggaagcuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44234 - RNA, 1701 nt, Artificial Sequence
  hemagglutinin__InfluenzaA__BAJ39983
augaaggcaauauuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggaucuugggaaauccagagugugaaucacucuccacagcaagcucaugguccuacauugcggaaacaucuaguucagacaauggaacguguuacccaggagauuucaucgauuaugaggagcuaagagagcaauugagcucagugucaucauuugaaagguuugagauauuccccaagacuaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44235 - RNA, 1701 nt, Artificial Sequence
  hemagglutinin__InfluenzaA__BAJ39984
augaaggcaauauuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaauuacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccaugauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44236 - RNA, 1701 nt, Artificial Sequence; identical to SEQ ID NO: 44214
  hemagglutinin__InfluenzaA__BAJ39985

SEQ ID NO: 44237 - RNA, 1701 nt, Artificial Sequence
  hemagglutinin__InfluenzaA__BAJ39987
augaagacaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcugguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucaaaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44238 - RNA, 1701 nt, Artificial Sequence
  hemagglutinin__InfluenzaA__BAJ39988
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuauccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagcaucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguucaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaucacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44239 - RNA, 1701 nt, Artificial Sequence
  hemagglutinin__InfluenzaA__BAJ39989
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaaugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaguguaaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44240 - RNA, 1701 nt, Artificial Sequence; identical to SEQ ID NO: 34259
  hemagglutinin__InfluenzaA__BAJ39990

SEQ ID NO: 44241 - RNA, 1701 nt, Artificial Sequence
  hemagglutinin__InfluenzaA__BAJ39993
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugauggguuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44242 - RNA, 1701 nt, Artificial Sequence
  hemagglutinin__InfluenzaA__BAJ39994
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagauuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaccacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaaaaagccaguuaaaaaacaaugccaaggaaauuggaaacggcugcuuugaauuuuaccacaaaugcgauaacacgugcuuggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44243 - RNA, 1701 nt, Artificial Sequence
  hemagglutinin__InfluenzaA__BAJ39996
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacuaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44244 - RNA, 1701 nt, Artificial Sequence
  hemagglutinin__InfluenzaA__BAJ39997
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagauuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaccacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44245 - RNA, 1701 nt, Artificial Sequence; identical to SEQ ID NO: 44214
  hemagglutinin__InfluenzaA__BAJ39998

SEQ ID NO: 44246 - RNA, 1701 nt, Artificial Sequence
  hemagglutinin__InfluenzaA__BAJ39999
augaaggcaauacuaguaguucugcuauauacauuugcaaccgcaaaugcagacacauuauguauagguuaucaugcgaacaauucaacagacacuguagacacaguacuagaaaggaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44247 - RNA, 1701 nt, Artificial Sequence
  hemagglutinin__InfluenzaA__BAJ40000
augaagacaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcugguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44248 - RNA, 1701 nt, Artificial Sequence
  hemagglutinin__InfluenzaA__BAJ40001
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacuaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggguugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaaaaagccaguuaaaaaacaaugccaaggaaauuggaaacggcugcuuugaauuuuaccacaaaugcgauaacacgugcauggaaaguguaaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44249 - RNA, 1701 nt, Artificial Sequence
  hemagglutinin__InfluenzaA__BAJ40002
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggguugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44250 - RNA, 1701 nt, Artificial Sequence
  hemagglutinin__InfluenzaA__BAJ40003
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaaaaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44251 - RNA, 1701 nt, Artificial Sequence
  hemagglutinin__InfluenzaA__BAJ40004
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggugaaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaaaaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44252 - RNA, 1701 nt, Artificial Sequence
  hemagglutinin__InfluenzaA__BAJ40006
augaaggcaauacuaguaguucugcuauauacauuugcaaccgcaaaugcagacacauuauguauagguuaucaugcgaacaauucaacugacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggagagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44253 - RNA, 1701 nt, Artificial Sequence; identical to SEQ ID NO: 34259
  hemagglutinin__InfluenzaA__BAJ40007

SEQ ID NO: 44254 - RNA, 1701 nt, Artificial Sequence
  hemagglutinin__InfluenzaA__BAJ40008
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacuaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggguugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugauggguuccuggacauuuggacuuacauugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44255 - RNA, 1701 nt, Artificial Sequence
  hemagglutinin__InfluenzaA__BAJ40009
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucggacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaauggacuauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaauagaauagagaauuuaaauaaaaagguugaugaugguuuccuggacauuuggacuuacaaugccgaacuguugguucuauuggaaaaugaaagaacuuuggacuaccaugauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44256 - RNA, 1701 nt, Artificial Sequence
  hemagglutinin__InfluenzaA__BAJ40010
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaauuacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucggacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaauggacuauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccaugauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44257 - RNA, 1701 nt, Artificial Sequence; identical to SEQ ID NO: 44246
  hemagglutinin__InfluenzaA__BAJ40011

SEQ ID NO: 44258 - RNA, 1701 nt, Artificial Sequence
  hemagglutinin__InfluenzaA__BAJ40012
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuaggggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguuuaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaguguaaaaaaugggacuuaugacuacccaaaauacucagaggaagcaaaauuaaacagagaagaaauagaugggauaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44259 - RNA, 1701 nt, Artificial Sequence; identical to SEQ ID NO: 44246
  hemagglutinin__InfluenzaA__BAJ40013

SEQ ID NO: 44260 - RNA, 1701 nt, Artificial Sequence; identical to SEQ ID NO: 44246
  hemagglutinin__InfluenzaA__BAJ40014

SEQ ID NO: 44261 - RNA, 1701 nt, Artificial Sequence
  hemagglutinin__InfluenzaA__BAJ40015
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucauugauuaugaggagcuaagagagcaauugagcucagugucaucauuugaaagguuugagauauuccccaauacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44262 - RNA, 1701 nt, Artificial Sequence; identical to SEQ ID NO: 44246
  hemagglutinin__InfluenzaA__BAJ40016

SEQ ID NO: 44263 - RNA, 1701 nt, Artificial Sequence
  hemagglutinin__InfluenzaA__BAJ40017
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucagaauauacauccgaucacaauuggaaaauguccaaaauauguaaaaagcacaaaauugagacuggccacaggauugaggaaugucccgucuauucaaucuaggggccuauuuggggccauugccgguuucauugaagggggguggacagggaugguagauggaugguacgguuaucaccaucaaaaugagcaggggucaggauaugcagccgaccugaaaagcacacagaaggccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaguguaaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44264 - RNA, 1701 nt, Artificial Sequence; identical to SEQ ID NO: 34337
  hemagglutinin__InfluenzaA__BAJ40018

SEQ ID NO: 44265 - RNA, 1701 nt, Artificial Sequence; identical to SEQ ID NO: 44252
  hemagglutinin__InfluenzaA__BAJ40019

SEQ ID NO: 44266 - RNA, 1701 nt, Artificial Sequence
  hemagglutinin__InfluenzaA__BAJ40020
augaaggcaauacuaguaguucugcuauauacauuugcaaccgcaaaugcagacacauuauguauagguuaucaugcgaacaauucaacugacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggagagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44267 - RNA, 1701 nt, Artificial Sequence
  hemagglutinin__InfluenzaA__BAJ40021
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggugaaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44268 - RNA, 1701 nt, Artificial Sequence
  hemagglutinin__InfluenzaA__BAJ40023
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggaggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44269 - RNA, 1701 nt, Artificial Sequence
  hemagglutinin__InfluenzaA__BAJ40024
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggauuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44270 - RNA, 1701 nt, Artificial Sequence; identical to SEQ ID NO: 44246
  hemagglutinin__InfluenzaA__BAJ40025

SEQ ID NO: 44271 - RNA, 1701 nt, Artificial Sequence; identical to SEQ ID NO: 34337
  hemagglutinin__InfluenzaA__BAJ40026

SEQ ID NO: 44272 - RNA, 1701 nt, Artificial Sequence
  hemagglutinin__InfluenzaA__BAJ40027
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggugaaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaaaaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44273 - RNA, 1701 nt, Artificial Sequence
  hemagglutinin__InfluenzaA__BAJ40028
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgcuuucauugaagggggguggacagggaugguagauggaugguacgguuaucaccaucaaaaugagcaggggucaggauaugcagccgaccugaaaagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44274 - RNA, 1701 nt, Artificial Sequence
  hemagglutinin__InfluenzaA__BAJ40029
augaaggcaauacuaguaguucugcuauauacauuugcaaccgcaaaugcagacacauuauguauagguuaucaugcgaacaauucaacagacacuguagacacaguacuagaaaggaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaucaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44275 - RNA, 1701 nt, Artificial Sequence
  hemagglutinin__InfluenzaA__BAJ40030
augaaggcaauacuaguaguucugcuauauacauuugcaaccgcaaaugcagacacauuauguauagguuaucaugcgaacaauucaacugacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaaaagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggagagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44276 - RNA, 1701 nt, Artificial Sequence; identical to SEQ ID NO: 44214
  hemagglutinin__InfluenzaA__BAJ40031

SEQ ID NO: 44277 - RNA, 1701 nt, Artificial Sequence; identical to SEQ ID NO: 44246
  hemagglutinin__InfluenzaA__BAJ40032

SEQ ID NO: 44278 - RNA, 1701 nt, Artificial Sequence; identical to SEQ ID NO: 44275
  hemagglutinin__InfluenzaA__BAJ40033

SEQ ID NO: 44279 - RNA, 1701 nt, Artificial Sequence
  hemagglutinin__InfluenzaA__BAJ40034
augaaggcaauacuaguaguucugcuauauacauuugcaaccgcaaaugcagacacauuauguauagguuaucaugcgaacaauucaacagacacuguagacacaguacuagaaaggaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44280 - RNA, 1701 nt, Artificial Sequence
  hemagglutinin__InfluenzaA__BAJ40035
augaaggcaauacuaguaguucugcuauauacauuugcaaccgcaaaugcagacacauuauguauagguuaucaugcgaacaauucaacagacacuguagacacaguacuagaaaagaacguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagauuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaaaauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccaucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44281 - RNA, 1701 nt, Artificial Sequence
  hemagglutinin__InfluenzaA__BAJ40036
augaaggcaauacuaguaguucugauauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacuaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacaauaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggguugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugauggguuccuggacauuuggacuuacaaugccgaacuguugguucuauuggaaaaugaaagaacuuuggacuaccacgauucaaaugugaagaacuuauaugaaaagguaaaaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44282 - RNA, 1701 nt, Artificial Sequence; identical to SEQ ID NO: 44203
  hemagglutinin__InfluenzaA__BAJ40037

SEQ ID NO: 44283 - RNA, 1701 nt, Artificial Sequence
  hemagglutinin__InfluenzaA__BAJ40038
augaaggcaauacuacuaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacaauaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44284 - RNA, 1701 nt, Artificial Sequence
  hemagglutinin__InfluenzaA__BAJ40039
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacuaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacuauuggaaaauguccaaaauauguaaaaagcacaaaauugagacuggccacaggguugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugauggguuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44285 - RNA, 1701 nt, Artificial Sequence
  hemagglutinin__InfluenzaA__BAJ40040
augaaggcaauacuaguaguucugcuauauacauuugcaaccgcaaaugcagacacauuauguauagguuaucaugcgaacaauucaacugacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggagagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggauaugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44286 - RNA, 1701 nt, Artificial Sequence
  hemagglutinin__InfluenzaA__BAJ40041
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcugguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguaugguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44287 - RNA, 1701 nt, Artificial Sequence
  hemagglutinin__InfluenzaA__BAJ40042
augaaggcaauacuaguaguucugcuauauacauuugcaaccgcaaaugcagacacauuauguauagguuaucaugcgaacaauucaacugacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaaaagagccauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggagagaaguccucgugcuauggggcauucaccauccaucuacuagugcugaccgacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44288 - RNA, 1701 nt, Artificial Sequence
  hemagglutinin__InfluenzaA__BAJ40043
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccaaauuuuggcgaucuauucaacugucgccaguucauugguacugguagucucccugggggcaaucaguuucuggaugugcucuaaugggucucuacaguguagaauauguauuuaa

SEQ ID NO: 44289 - RNA, 1701 nt, Artificial Sequence
  hemagglutinin__InfluenzaA__BAJ40044
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcaaaaagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaauaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44290 - RNA, 1701 nt, Artificial Sequence; identical to SEQ ID NO: 44252
  hemagglutinin__InfluenzaA__BAJ40045

SEQ ID NO: 44291 - RNA, 1701 nt, Artificial Sequence
  hemagglutinin__InfluenzaA__BAJ40046
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguagauguaacauugcuggcuggauccugggaaauccagagugugaaucacucuccacagcaagcucaugguccuacauuguggaaacaucuauuucagacaauggaacguguuacccaggagauuucaucgauuaugaggagcuaaaagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaaaaauagagaauuuaaauaaaaaaguugaugaugguuuccuggacauuuggacuuacaaugccaaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44292 - RNA, 1701 nt, Artificial Sequence; identical to SEQ ID NO: 44275
  hemagglutinin__InfluenzaA__BAJ40047

SEQ ID NO: 44293 - RNA, 1701 nt, Artificial Sequence
  hemagglutinin__InfluenzaA__BAJ40048
augaaggcaauacuaguaguucugcuauacacauuugcaaccgcaaaugcagacacauuauguauagguuaucaugcgaacaauucaacagacacuguagacacaguacuagaaaggaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44294 - RNA, 1701 nt, Artificial Sequence
  hemagglutinin__InfluenzaA__BAJ40050
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaaaagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccuuccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44295 - RNA, 1701 nt, Artificial Sequence
  hemagglutinin__InfluenzaA__BAJ40051
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaaucuuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44296 - RNA, 1701 nt, Artificial Sequence
  hemagglutinin__InfluenzaA__BAJ40052
augaaggcaauacuaguaguucugcuauauacauuugcaaccgcaaaugcagacacauuauguauagguuaucaugcgaacaauucaacugacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggagacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggagagaaguccuugugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44297 - RNA, 1701 nt, Artificial Sequence
  hemagglutinin__InfluenzaA__BAJ40053
augaaggcaauacuaguaguucugcuauauacauuugcaaccgcaaaugcagacacauuauguauagguuaucaugcgaacaauucaacagacacuguagacacaguacuagaaaagaacguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaaugggacguguuacccaggagauuucaucgauuaugaggagcuaagagagcaauugagcucagugucaucauuugaaagauuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccaucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44298 - RNA, 1701 nt, Artificial Sequence
  hemagglutinin__InfluenzaA__BAJ40054
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccuuccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44299 - RNA, 1701 nt, Artificial Sequence
  hemagglutinin__InfluenzaA__BAJ40055
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcugguuaaaaaaggaaauucauacccaaagcucagcaaauccuacauuaaugauaaagggaaagaaguccucgugcuauggggcauucaccauccaucuacuaguacugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaauuugucagacacccaagggugcuauaaacaccagccucccauuucagaauauacauccgaucacaauuggaaaauguccaaaauauguaaaaagcacaaaauugagacuggccacaggauugaggaaugucccgucuguucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44300 - RNA, 1701 nt, Artificial Sequence
  hemagglutinin__InfluenzaA__BAJ40056
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaauuacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcaaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagacaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcccaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccaugauucauaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44301 - RNA, 1701 nt, Artificial Sequence
  hemagglutinin__InfluenzaA__BAJ40057
augaaggcaauacuaguaguucugcuauacacauuugcaaccgcaaaugcagacacauuauguauagguuaucaugcgaacaauucaacagacacuguagacacaguacuagaaaggaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacgaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaguguaaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44302 - RNA, 1701 nt, Artificial Sequence; identical to SEQ ID NO: 44203
  hemagglutinin__InfluenzaA__BAJ40058

SEQ ID NO: 44303 - RNA, 1701 nt, Artificial Sequence; identical to SEQ ID NO: 44246
  hemagglutinin__InfluenzaA__BAJ40059

SEQ ID NO: 44304 - RNA, 1701 nt, Artificial Sequence; identical to SEQ ID NO: 34337
  hemagglutinin__InfluenzaA__BAJ40060

SEQ ID NO: 44305 - RNA, 1701 nt, Artificial Sequence
  hemagglutinin__InfluenzaA__BAJ40061
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaggcaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44306 - RNA, 1701 nt, Artificial Sequence
  hemagglutinin__InfluenzaA__BAJ40062
augaaggcaauacuaguaguuuugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucauugauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaaaaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguaaaauauguauuuaa

SEQ ID NO: 44307 - RNA, 1701 nt, Artificial Sequence
  hemagglutinin__InfluenzaA__BAJ40063
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaggcaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggaggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44308 - RNA, 1701 nt, Artificial Sequence
  hemagglutinin__InfluenzaA__BAJ40064
augaaggcaauacuaguaguucugcuauauacauuugcaaccgcaaaugcagacacauuauguauagguuaucaugcgaacaauucgacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44309 - RNA, 1707 nt, Artificial Sequence
  hemagglutinin__InfluenzaA__BAK23398
auggagaaaauagugcuucuucuugcaauagucagucuuguuaaaagugaucagauuugcauugguuaccaugcaaacaacucgacagagcagguugacacaauaauggaaaagaacgucacuguuacacacgcccaagacauacuggaaaagacacacaacgggaaacucugcgaucuagauggagugaagccucuaauuuuaagagauuguaguguagcuggguggcuccucgggaauccaaugugugacgaauuccucaaugugccggaauggucuuacauaguggagaagaucaauccagucaaugaccucuguuacccagggaauuucaacgacuaugaagaacugaaacaccuauugagcagaauaaaccauuuugagaaaauucagaucuuccccaaaaguucuuggucagaccaugaagccucaucaggggugagcucagcauguccauaccagggaagauccuccuuuuuuagaaaugugguauggcuugucaaaaaggacaaugcauacccaacaauaaagaaaaguuacaauaauaccaaccaagaagaccuuuugauacugugggggauucaccauccaaaugaugcggcagagcagacaaggcucuaucaaaacccaacuaccuauauuuccguugggacaucaacacuaaaccagagauugguaccaaaaauagcuacuagaucuaagguaaaugggcaaaguggaaggauugaguucuuuuggacaauuuuaaaaucgaaugauguaauaaacuuugagaguaauggaaauuucauugcuccagaaaaugcauacaaaauugucaagaaaggggacucaacaauuaugaaaagugaguuggaauaugguaacugcaacaccaagugucaaacuccaauaggggcgauaaacuccaguaugccauuccacaacauccacccucucaccaucggggaaugccccaaauaugugaaaucaaacagauuaguccuugcuacugggcucagaaauagcccucgaggagagagaagaagaaaaaagagaggacuauuuggagcuauagcaggcuuuauagagggaggauggcagggaaugguagacgguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaauaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuugguaacgguuguuucgaguucuaucacagaugugauaaugaauguauggaaaguguaaaaaacggaacguaugacuacccgcaguauucagaagaagcaagauuaaagagagaggaaauaaguggaguaaaauuggaaucaauaggaacuuaccaaauacugucaauuuauucaacaguggcgagcucccuagcacuggcaaucaugauggcuggucuauuuuuauggaugugcuccaaugggucguuacaaugcagaauuugcauuuaa

SEQ ID NO: 44310 - RNA, 1707 nt, Artificial Sequence
  hemagglutinin__InfluenzaA__BAK23400
auggagaaaauagugcuucuucuugcaauagucagucuuguuaaaagugaucaaauuugcauugguuaccaugcaaacaacucgacagaacagguugacacaauaauggaaaagaacgucacuguuacacacgcccaagacauacuggaaaagacacacaacgggaagcuaugcgaucuaaauggagugaagccucuaauuuuaagagauuguaguguagcuggauggcuccucgggaacccaaugugugacgaauuccucaaugugccggaauggucuuacauaguggagaagaucaauccagccaaugaccucuguuacccaggggauuucaacgacuaugaagaacugaaacaccuauugagcagaauaaaccauuuugagaaaauucagaucauccccaaaaguucuuggucagaucaugaagcaucgucaggagugagcucagcauguccauaccagggaagauccuccuuuuuuagaaaugugguauggcuuaucaaaaaggacaaugcauacccaacaauaaaaagaaguuacaauaauaccaaccaagaagaucuuuugguacugugggggauucaccauccgaaugaugcggcagagcagacaaggcucuaucauaacccaacuaccuauauuuccguugggacaucaacacuaaaccagagauugguaccaaaaauagcuacuagaucuaagguaaaugggcaaaguggaaggauggaguucuuuuggacaauuuuaaaaccgaaugaugcaauaaacuuugagaguaauggaaauuucauugcuccagaaaaugcauacaaaauugucaagaaaggggacucaacaauuaugaaaagugaguuggaauaugguaacugcaacaccaagugucaaacuccaauaggggcgauaaacuccaguaugccauuccacaacauccacccucucaccaucggggaaugccccaaauaugugaaaucaagcagauuaguccuugcuacugggcucagaaauaguccucaaggaaagaguagaagaaaaaagagaggacuauuuggagcuauagcaggguuuauagagggaggauggcagggaaugguagaugguugguauggguaccaccauagcaacgagcaggggaguggguacgcugcagacaaagaauccacucaaagggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaauguuaagaaucuuuacgacaagguccgacuacagcuuagggauaaugcaaaggagcuuggcaacgguuguuucgaguucuaucacagaugugauaaugaauguauggaaaguguaagaaacggaacguaugacuacccgcaguauucagaagaagcaagauuaaaaagagaggaaauaaguggaguaaaauuggaaucaauaggaauuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 44311 - RNA, 1707 nt, Artificial Sequence
  hemagglutinin__InfluenzaA__BAK23401
auggagaaaauagugcuucuucuugcaauagucagucuuguuaaaagugaucagauuugcauugguuaccaugcaaacaacucaacagagcagguugacacaauaauggaaaagaacgucacuguuacacacgcucaagacauacuggaaaagacacacaacgggaaacucugcgaucuagauggagugaagccucuaauuuuaagagauuguaguguagcuggauggcuccucgggaacccaaugugugacgaauuccucaaugugucggaauggucuuacauaguggagaagaucaauccagccaaugaccucuguuacccagggaauuucaacaacuaugaagaacugaaacaccuauugagcagaauaaaccguuuugagaaaauucagaucauccccaaaaguucuuggccagaucaugaagccucacuaggagugagcucagcauguccauaccagggaggacccuccuuuuauagaaaugugguauggcuuaucaaaaagaacaauacauacccaauaauaaagaaaaguuaccauaauaccaaucaagaagaucuuuuggugcugugggggauucaucauccaaaugaugaggaagagcagacaaggaucuauaaaaacccaacuaccuauauuuccguugggacaucaacacuaaaccagagauugguaccaaagauagccacuagaucuaagguaaacgggcaaaguggaaggguggaguucuuuuggacaauuuuaaaaucaaaugauacaauaaacuuugagaguaauggaaauuucauugcuccagaaaaugcauacaaaauugucaagaagggggacucaacaauuaugaaaagugaguuggaauaugguaacugcaacaccaagugucaaacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacauucaguuugaggcuguuggaagggaauuuaauaacuuggaaaggagaauagaaaauuuaaacaagaagauggaagacggguuccuagaugucuggacuuauaaugcugaacuucugguucucauggaaaaugagagaacucuagauuuucaugacucaaaugucaagaaccuuuaugacaaggugcgacuacagcuuagggauaaugcaaaggagcuugguaacgguuguuucgaguucuaucacagaugcgauaaugaauguauggaaaguguaagaaacggaacguaugacuacccgcaguauucagaagaagcaagauuaaaaagagaggaaauaaguggaguaaaauuggaaucaauaggaacuuaccaaauacuaucaauuuauucaacaguggcaaguucccuagcacuggcaaucaugguggcuggucuauuuuuauggaugugcuccaauggaucguuacaaugcagaauuugcauuuaa

SEQ ID NO: 44312 - RNA, 1707 nt, Artificial Sequence
  hemagglutinin__InfluenzaA__BAK23402
auggagaaaauagugcuucuucuugcaauagucagucuuguuaaaagugaucagauuugcauugguuaccaugcaaacaacucgacagagcagguugacacaauaauggaaaagaaugucacuguuacacacgcccaagacauacuggaaaagacacacaacgggaagcucugcgaucuagauggaguuaagccucuaauuuuaagagauuguaguguagcuggauggcuccucgggaacccaaugugugacgaauuccucaaugugccggaauggucuuacauaguggagaagaucaauccagccaaugaccucuguuacccagggaauuucaacgacuaugaagaacugaaacaccuauugagcagaauaaaucauuuugagaaaauucagaucauccccaaaaguucuuggucaaaucaugaagccucaucaggagugagcucagcauguccauaccagggaagauccuccuuuuuuagaaaugugguauggcuuaucaaaaaggacaaugcauacccaacaauaaagauaaguuacaauaauaccaaccaagaagaucuuuugguacugugggggauucaccauccaaaugaugcggcagagcagacaaggcucuaucaaaacccaacuaccuauauuuccguugggacaucaacauuaaaccagagauugguaccaaaaauagcuacuagaucuaagguaaacgggcaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacugcaacaccaagugucaaacuccaauaggggcgauaaacuccaguaugccauuccacaacacccacccucucaccaucggggaaugccccaaauaugugaaaucaaacagauuaguccuugcuacugggcucagaaauagcccucauggagagagaagaagaaaaaagagaggacuauuuggagcuauagcagguuuuauagagggaggauggcagggaaugguagaugguugguauggguaccaccauagcaacgagcaggggaguggguacgcugcagacaaggaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 44313 - RNA, 1707 nt, Artificial Sequence
  hemagglutinin__InfluenzaA__BAK23403
auggagaaaauagugcuucuucuugcaauagucagucuuguuaaaagugaucagauuugcauugguuaccaugcaaacaacucgacagagcagguugacacaauaauggaaaagaaugucacuguuacacacgcccaagacauacuggaaaagacacacaacgggaagcucugcgaucuagauggaguuaagccucuaauuuuaagagauuguaguguagcuggauggcuccucgggaacccaaugugugacgaauuccucaaugugccggaauggucuuacauaguggagaagaucaauccagccaaugaccucuguuacccagggaauuucaacgacuaugaagaacugaaacaccuauugagcagaauaaaucauuuugagaaaauucagaucauccccaaaaguucuuggucaaaucaugaagccucaucaggagugagcucagcauguccauaccagggaagauccuccuuuuuuagaaaugugguauggcuuaucaaaaaggacaaugcauacccaacaauaaagauaaguuacaauaauaccaaccaagaagaucuuuugguacugugggggauucaccauccaaaugaugcggcagagcagacaaggcucuaucaaaacccaacuaccuauauuuccguugggacaucaacauuaaaccagagauugguaccaaaaauagcuacuagaucuaagguaaacgggcaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacugcaacaccaagugucaaacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaggaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 44314 - RNA, 1707 nt, Artificial Sequence
  hemagglutinin__InfluenzaA__BAK23404
auggagaaaauagugcuucuucuugcaauagucagucuuguuaaaagugaucagauuugcauugguuaccaugcaaacaacucgacagagcagguugacacaauaauggaaaagaacgucacuguuacacacgcccaagacauacuggaaaagacacacaacgggaaacucugcgaucuagauggagugaagccucuaauuuuaagagauuguaguguagcuggauggcuccucgggaacccaaugugugacgaauuccucaaugugccggaauggucuuacauaguggagaagaucaauccagccaaugaccucuguuacccagggaauuucaacgacuaugaagaacugaaacaccuauugagcagaauaaaccauuuugagaaaauucagaucauccccaaaaguucuuggucagaucaugaagccucaucaggagugagcucagcauguccauaccagggaagauccuccuuuuuuagaaaugugguauggcuuaucaaaaaggacaaugcauacccaacaauaaagagaaguuacaauaauaccaaccaagaagaucuuuugguacugugggggauucaccauccgaaugaugcggcagagcagacaaggcucuaucaaaacccaacuaccuauauuuccguugggacaucaacacuaaaccagagauugguaccaaaaauagcuacuagaucuaagguaaacgggcaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacugcaacaccaagugucaaacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccggcuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 44315 - RNA, 1707 nt, Artificial Sequence
  hemagglutinin__InfluenzaA__BAK23405
auggagaaaauagugcuucuucuugcaauagucagucuuguuaaaagugaucagauuugcauugguuaccaugcaaacaacucgacagagcagguugacacaauaauggaaaagaacgucacuguuacacacgcccaagacauacuggaaaagacacacaacgggaaacucugcgaucuagauggagugaagccucuaauuuuaagagauuguaguguagcuggauggcuccucgggaacccaaugugugacgaauuccucaaugugccggaauggucuuacauaguggagaagaucaauccagccaaugaccucuguuacccagggaauuucaacgacuaugaagaacugaaacaccuauugagcagaauaaaccauuuugagaaaauucagaucauccccaaaaguucuuggucagaucaugaagccucaucaggagugagcucagcauguccauaccagggaagauccuccuuuuuuagaaaugugguauggcuuaucaaaaaggacaaugcauacccaacaauaaagagaaguuacaauaauaccaaccaagaagaucuuuugguacugugggggauucaccauccgaaugaugcggcagagcagacaaggcucuaucaaaacccaacuaccuauauuuccguugggacaucaacacuaaaccagagauugguaccaaaaauagcuacuagaucuaagguaaacgggcaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacugcaacaccaagugucaaacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 44316 - RNA, 1707 nt, Artificial Sequence
  hemagglutinin__InfluenzaA__BAK23406
auggagaaaauagugcuucuucuugcaauagucagucuuguuaaaagugaucagauuugcauugguuaccaugcaaacaacucgacagagcagguugacacaauaauggaaaagaacgucacuguuacacacgcccaagacauacuggaaaagacacacaacgggaaacucugcgaucuagauggagugaagccucuaauuuuaagagauuguaguguagcuggguggcuccucgggaacccaaugugugacgaauuccucaaugugccggaauggucuuacauaguggagaagaucaauccagucaaugaccucuguuacccagggaauuucaacgacuaugaagaacugaaacaccuauugagcagaauaaaccauuuugagaaaauucagaucuuccccaaaaguucuuggucagaccaugaagccucaucaggggugagcucagcauguccauaccagggaagauccuccuuuuuuagaaaugugguauggcuugucaaaaaggacaaugcauacccaacaauaaagaaaaguuacaauaauaccaaccaagaagaucuuuugauacugugggggauucaccauccaaaugaugcggcagagcagacaaggcucuaucaaaacccaacuaccuauauuuccguugggacaucaacacuaaaccagagauugguaccaaaaauagcuacuagaucuaagguaaacgggcaaaguggaaggauugaguucuuuuggacaauuuuaaaaucgaaugauguaauaaacuuugagaguaauggaaauuucauugcuccagaaaaugcauacaaaauugucaagaaaggggacucaacaauuaugaaaagugaguuggaauaugguaacugcaacaccaagugucaaacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagaggacuauuuggagcuauagcaggcuuuauagagggaggauggcagggaaugguagacgguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaauaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuugguaacgguuguuucgaguucuaucacagaugugauaaugaauguauggaaaguguaaaaaacggaacguaugacuacccgcaguauucagaagaagcaagauuaaagagagaggaaauaaguggaguaaaauuggaaucaauaggaacuuaccaaauacugucaauuuauucaacaguggcgagcucccuagcacuggcaaucaugauggcuggucuauuuuuauggaugugcuccaaugggucguuacaaugcagaauuugcauuuaa

SEQ ID NO: 44317 - RNA, 1707 nt, Artificial Sequence
  hemagglutinin__InfluenzaA__BAK23407
auggagaaaauagugcuucuucuugcaauagucagucuuguuaaaaguggucagauuugcauugguuaccaugcaaacaacucaacagagcagguugacacaauaauggaaaagaacgucacuguuacacacgcucaagacauacuggaaaagacacacaacgggaaacucugcgaucuagauggagugaagccucuaauuuuaagagauuguaguguagcuggauggcuccucgggaacccaaugugugacgaauuccucaaugugucggaauggucuuacauaguggagaagaucaauccagccaaugaccucuguuacccagggaauuucaacaacuaugaagaacugaaacaccuauugagcagaauaaaccguuuugagaaaauucagaucauccccaaaaguucuuggccagaucaugaagccucauuaggagugagcgcagcauguccauaccagggaggacccuccuuuuauagaaaugugguauggcuuaucaaaaagaacaauacauacccaacaauagagaaaaguuaccauaauaccaaucaagaagaucuuuuggugcugugggggauucaccauccaaaugaugaggcagagcagacaaggaucuauaaaaacccaacuaccuauauuuccguugggacaucaacacuaaaccagagauugguaccaaagauagccacuagaucuaagguaaacgggcaaaguggaaggguggaguucuuuuggacaauuuuaaaaucaaaugauacaauaaacuuugagaguaauggaaauuucauugcuccagaaaaugcauacaaaauugucaagaaaggggacucaacaauuaugaaaagugaguuggaauaugguaacugcaacaccaggugucaaacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuggaaaggagaauagaaaauuuaaacaagaagauggaagacggguuccuagaugucuggacuuauaaugcugaacuucugguucucauggaaaaugagagaacucuagacuuucaugacucaaaugucaagaaccuuuacgacaaggugcgacuacagcuuagggauaaugcaaaggagcuugguaacgguuguuucgaguucuaucacagaugcgauaaugaauguauggaaaguguaagaaacggaacguaugacuacccgcaguauucagaagaagcaagauuaaaaagagaggaaauaaguggaguaaaauuggaaucaauaggaacuuaccaaauacuaucaauuuauucaacaguggcaaguucccuagcacuggcaaucaugguggcuggucuauuuuuauggaugugcuccaauggaucguuacaaugcagaauuugcauuuaa

SEQ ID NO: 44318 - RNA, 1707 nt, Artificial Sequence
  hemagglutinin__InfluenzaA__BAK23408
auggagaaaauagugcuucuucuugcaauagucagucuuguuaaaagugaucagauuugcauugguuaccaugcaaacaacucaacagagcaaguugacacaauaauggaaaagaacgucacuguuacacacgcucaagacauacuggaaaagacacacaacgggaaacucugcgaucuagauggagugaagccucuaauuuuaagagauuguaguguagcuggauggcuccucgggaacccaaugugugacgaauuccccaaugugucggaauggucuuacauaguggagaagaucaauccagccaaugaccucuguuacccagggaauuucaacaacuaugaagaacugaaacaccuauugagcagaauaaaccguuuugagaaaauucagaucauccccaaaaguucuuggccagaucaugaagccucauuaggagugagcucagcaugucaauaccagggaggacccuccuuuuauagaaaugugguauggcuuaucaaaaaggacaaugcauacccaacaauaaagaaaaguuaccauaauaccaauaaagaagaucuuuugguacugugggggauucaccauccaaauaaugaggaagagcagacaaagcucuaucaaaacccaacuaccuauauuuccguugggacaucaacacuaaaccagagauugguaccaaagauagcuacuagaucuaagguaaacgggcaaaguggaaggguggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacuacaacaccaagugucaaacuccaauaggggcgauaaacuccaguaugccauuccacaacauccacccucucaccaucggggaaugccccaaauaugugaagucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaagucaacucgaucauugacaaaaugaacacucaguuugaggcuguuggaaaggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaaggugcgacuacagcuuagggauaacgcaaaggagcuugguaacgguuguuucgaguucuaucacagaugugauaaugaauguauggaaaguguaagaaacggaacguaugacuacccgcaguauucugaagaagcaagauuaaaaagagaggaaauaaguggaguaaaguuggagucaauaggaacuuaccaaauacugucaauuuacucaacaguggcaaguucccuagcacuggcaaucaugguggcuggucuauuuuuauggaugugcuccaauggaucguuacaaugcagaauuugcauuuaa

SEQ ID NO: 44319 - RNA, 1707 nt, Artificial Sequence
  hemagglutinin__InfluenzaA__BAK23411
auggagaaaauagugcuucuucuugcaauagucagucuuguuaaaagugaucagauuugcauugguuaccaugcaaacaacucaacagagcagguugacacaauaauggaaaagaacgucacuguuacacacgcucaagacauacuggaaaagacacacaacgggaaacucugcgaucuagauggagugaagccucuaauuuuaagagauuguaguguagcuggauggcuccucgggaacccaaugugugacgaauuccucaaugugucggaauggucuuacauaguggagaagaucaauccagccaaugaccucuguuacccagggaauuucaacaacuaugaagaacugaaacaccuauugagcagaauaaaccguuuugagaaaauucagaucauccccaaaaguucuuggccagaucaugaagccucauuaggagugagcucagcaugucaauaccagggaggacccuccuuuuauagaaaugugguauggcuuaucaaaaaggacaaugcauacccaacaauaaagaaaaguuaccauaauaccaauaaagaagaucuuuugguacugugggggauucaccauccaaauaaugaggaagagcagacaaagcucuaucaaaacccaacuaccuauauuuccguugggacaucaacacuaaaccagagauugguaccaaagauagcuacuagaucuaagguaaacgggcaaaguggaaggguggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacugcaacaccaagugucaaacuccaauaggggcgauaaacuccaguaugccauuccacaacauccacccucucaccaucggggaaugccccaaauaugugaagucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaagucaacucgaucauugacaaaaugaacacucaguuugaggcuguuggaaaggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaaggugcgacuacagcuuagggauaacgcaaaggagcuugguaacgguuguuucgaguucuaucacagaugugauaaugaauguauggaaaguguaagaaacggaacguaugacuacccgcaguauucugaagaagcaagauuaaaaagagaggaaauaaguggaguaaaguuggagucaauaggaacuuaccaaauacugucaauuuacucaacaguggcaaguucccuagcacuggcaaucaugguggcuggucuauuuuuauggaugugcuccaauggaucguuacaaugcagaauuugcauuuaa

SEQ ID NO: 44320 - RNA, 1707 nt, Artificial Sequence
  hemagglutinin__InfluenzaA__BAK23412
auggagaaaauagugcuucuucuugcaauagucagucuuguuaaaagugaucagauuugcauugguuaccaugcaaacaacucaacagagcagguugacacaauaauggaaaagaacgucacuguuacacacgcucaagacauacuggaaaagacacacaaagggaaacucugcgaucuagauggagugaagccucuaauuuuaagagauuguaguguagcuggauggcuccucgggaacccaaugugugacgaauuccucaaugugucggaauggucuuacauaguggagaagaucaauccagccaaugaccucuguuacccagggaauuucaacaacuaugaagaacugaaacaccuauugagcagaauaaaccguuuugagaaaauucagaucauccccaaaaguucuuggccagaucaugaagccucauuaggagugagcucagcaugucaauaccagggaggacccuccuuuuauagaaaugugguauggcuuaucaaaaaggacaauacauacccaacaauaaagaaaaguuaccauaauaccaauaaagaagaucuuuugguacugugggggauucaccauccaaauaaugaggaagagcagacaaagcucuaucaaaacccaacuaccuauauuuccguugggacaucaacacuaaaccagagauugguaccaaagauagcuacuagaucuaagguaaacgggcaaaguggaaggguggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacugcaacaccaagugucaaacuccaauaggggcgauaaacuccaguaugccauuccacaacauccacccucucaccaucggggaaugccccaaauaugugaagucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaagucaacucgaucauugacaaaaugaacacucaguuugaggcuguuggaaaggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaaggugcgacuacagcuuagggauaacgcaaaggagcuugguaacgguuguuucgaguucuaucacagaugugauaaugaauguauggaaaguguaagaaacggaacguaugacuacccgcaguauucugaagaagcaagauuaaaaagagaggaaauaaguggaguaaaguuggagucaacaggaacuuaccaaauacugucaauuuacucaacaguggcaaguucccuagcacuggcaaucaugguggcuggucuauuuuuauggaugugcuccaauggaucguuacaaugcagaauuugcauuuaa

SEQ ID NO: 44321 - RNA, 1707 nt, Artificial Sequence
  hemagglutinin__InfluenzaA__BAK23413
auggagaaaauagugcuucuucuugcaauagucagucuuguuaaaagugaucagauuugcauugguuaccaugcaaacaacucaacagagcagguugacacaauaauggaaaagaacgucacuguuacacacgcucaagacauacuggaaaagacacacaacgggaaacucugcgaucuagauggagugaagccucuaauuuuaagagauuguaguguagcuggauggcuccucgggaacccaaugugugacgaauuccucaaugugucggaauggucuuacauaguggagaagaucaauccagccaaugaccucuguuacccagggaauuucaacaacuaugaagaacugaaacaccuauugagcagaauaaaccguuuugagaaaauucagaucauccccaaaaguucuuggccagaucaugaagccucauuaggagugagcucagcaugucaauaccagggaggacccuccuuuuauagaaaugugguauggcuuaucaaaaaggacaauacauacccaacaauaaagaaaaguuaccauaauaccaauaaagaagaucuuuugguacugugggggauucaccauccaaauaaugaggaagagcagacaaagcucuaucaaaacccaacuaccuauauuuccguugggacaucaacacuaaaccagagauugguaccaaagauagcuacuagaucuaagguaaacgggcaaaguggaaggguggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacugcaacaccaagugucaaacuccaauaggggcgauaaacuccaguaugccauuccacaacauccacccucucaccaucggggaaugccccaaauaugugaagucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaagucaacucgaucauugacaaaaugaacacucaguuugaggcuguuggaaaggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaaggugcgacuacagcuuagggauaacgcaaaggagcuugguaacgguuguuucgaguucuaucacagaugugauaaugaauguauggaaaguguaagaaacggaacguaugacuacccgcaguauucugaagaagcaagauuaaaaagagaggaaauaaguggaguaaaguuggagucaauaggaacuuaccaaauacugucaauuuacucaacaguggcaaguucccuagcacuggcaaucaugguggcuggucuauuuuuauggaugugcuccaauggaucguuacaaugcagaauuugcauuuaa

SEQ ID NO: 44322 - RNA, 1707 nt, Artificial Sequence; identical to SEQ ID NO: 44319
  hemagglutinin__InfluenzaA__BAK23414

SEQ ID NO: 44323 - RNA, 1698 nt, Artificial Sequence
  hemagglutinin__InfluenzaA__BAM65746
auggaaguaaaacuacugguccuguuaugcacauuuacagcuacauaugcagacacaauauguauaggcuaccaugccaacaacucaaccgauacuguugacacauuacccgagaagaaugugacagugacacacucugucaaccugcuugaggacacucacaaugggaaauuaugucuauuaaaaggaauagccccacuacaauuggguaauugcagcguugccggauggaucuuaggaaacccagaaugcgaauuacugauuuccagggaaucaugguccuacauuguagaaaaaccaaauccugagaauggaauauguuacccagggcauuucgccgacuaugaggaacugagggaacaacugaguucaguaucuucauuugagagauucgaaauauuccccaaagaaagcucauggcccaaccauaccgcaaccggaguaucagcaucaugcucccauaaugggaaaagcaguuuuuacaaaaacuugcuguggcugacggugaagaaugguuuguacccaaaccugagcaaguccuaugcaaacaacaaagagaaagaaguccuugugcuaugggguguucaucacccgacuaacauaggugaccaaagggcccucuaucauacagaaaaugcuuaugucucuguagugucuucacauuauagcagaagauucaccccagaaauagccaaaagacccaaaguaagagaucaagaaggaagaaucaacuacuacuggacucugcuugaacccggggauacaauaauauuugaggcaaauggaaaucuaauagcgccaagauaugcguucgcacugaguaggggcuuuggaucaggaaucaucaaaucaaaugcaccaauggaugaauguaaugcgaagugccaaacaccucagggagccauaaacagcagucuuccuuuccagaauguacacccagucacaauaggagaguguccaaaguaugucaggaguacaaaauuaaggaugguuacaggacuaaggaacaccccauccauucaaucuagagguuuguuuggagccauugccgguuucauugaagggggguggacuggaaugguagaugguugguaugguuaucaccaucaaaaugagcaaggaucuggcuaugcugcagaucaaaaaagcacacaaaaugccauuaaugggauuacaaacaaggugaauucuguaauugagaaaaugaacacucaauucacagcuguggacaaagaauucaacaaacuggaaagaaggauggaaaacuuuaauaaaaagguugaugauggguuuauagacauuuggacauauaaugcagaauuguugauucuacuggaaaaugaaaggacucuggauuuccaugacuccaaugugaagaaucuguaugagaaaguaaaaagccaauuaaagaauaaugccaaagaaauaggaaauggauguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucuaugguucuuuuggucucccugggggcaaucagcuucuggauguguuccaaugggucuuugcaguguagaauaugcaucuag

SEQ ID NO: 44324 - RNA, 1701 nt, Artificial Sequence
  hemagglutinin__InfluenzaA__BAO79716
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcaacaguccucaucagauccuugauggagaaaacugcacacuaauagaugcucuauugggagacccucagugugauggcuuucaaaauaagaaaugggaccuuuuuguugaacgaagcaaagcauacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguccaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugaggucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccggagaaacaaacuagaggcauauuuggcgccauagcggguuucauagaaaaugguugggagggaaugauggaugguugguacgguuucaggcaucaaaauucugagggaagaggacaagcagcagaucucaaaagcacucaaucagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaaggggguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44325 - RNA, 1683 nt, Artificial Sequence
  Hemagglutinin__InfluenzaA__CAB95856
auggaaacaauaucacuaauaacuauacuacuaguaguaacagcaagcaaugcagauaaaaucugcaucggccaccagucaacaaacuccacagaaacuguggacacgcuaacagaaaccaauguuccugugacacaugccaaagaauugcuccacacagagcauaauggaaugcugugugcaacaagccugggacauccccucauucuagacacaugcacuauugaaggacuagucuauggcaacccuucuugugaccugcuguugggaggaagagaaugguccuacaucgucgaaagaucaucagcuguaaauggaacguguuacccugggaauguagaaaaccuagaggaacucaggacacuuuuuaguuccgcuaguuccuaccaaagaauccaaaucuucccagacacaaccuggaaugugacuuacacuggaacaagcagagcauguucagguucauucuacaggaguaugagauggcugacucaaaagagcgguuuuuacccuguucaagacgcccaauacacaaauaacaggggaaagagcauucuuuucguguggggcauacaucacccacccaccuauaccgagcaaacaaauuuguacauaagaaacgacacaacaacaagcgugacaacagaagauuugaauaggaccuucaaaccagugauagggccaaggccccuugucaauggucugcagggaagaauugauuauuauuggucgguacuaaaaccaggccaaacauugcgaguacgauccaaugggaaucuaauugcuccaugguauggacacguucuuucaggagggagccauggaagaauccugaagacugauuuaaaaggugguaauuguguagugcaaugucagacugaaaaagguggcuuaaacaguacauugccauuccacaauaucaguaaauaugcauuuggaaccugccccaaauauguaagaguuaauagucucaaacuggcagucggucugaggaacgugccugcuagaucaaguagaggacuauuuggagccauagcuggauucauagaaggagguuggccaggacuagucgcuggcugguaugguuuccagcauucaaaugaucaagggguugguauggcugcagauagggauucaacucaaaaggcaauugauaaaauaacauccaaggugaauaauauagucgacaagaugaacaagcaauaugaaauaauugaucaugaauucagugagguugaaacuagacucaauaugaucaauaauaagauugaugaccaaauacaagacguaugggcauauaaugcagaauugcuaguacuacuugaaaaucaaaaaacacucgaugagcaugaugcgaacgugaacaaucuauauaacaaggugaagagggcacugggcuccaaugcuauggaagaugggaaaggcuguuucgagcuauaccauaaaugugaugaucagugcauggaaacaauucggaacgggaccuauaauaggagaaaguauagagaggaaucaagacuagaaaggcagaaaauagaggggguuaagcuggaaucugagggaacuuacaaaauccucaccauuuauucgacugucgccucaucucuugugcuugcaaugggguuugcugccuuccuguucugggccauguccaauggaucuugcagaugcaacauuuguauauaa

SEQ ID NO: 44326 - RNA, 1683 nt, Artificial Sequence
  Hemagglutinin__InfluenzaA__CAB95857
auggaaacaauaucacuaauaacuauacuacuaguaguaacagcaagcaaugcagauaaaaucugcaucggccaccagucaacaaacuccacagaaacuguggacacgcuaacagaaaccaauguuccugugacacaugccaaagaauugcuccacacagagcacaauggaaugcugugugcaacaagucugggacauccccucauucuagacacaugcacuauugaaggauuagucuauggcaacccuucuugugaccugcuguuggaaggaagagaaugguccuacaucgucgaaagaucaucagcuguaaauggaacguguuacccugggaauguagaaaaccuagaggaacucaggacacuuuuuaguuccgcuaguuccuaccaaagaauccaaaucuucccagacacaaccuggaaugugacuuacacuggaacaagcagagcauguucagguucauucuacaggaguaugagauggcugacucaaaagagcgguuuuuacccuguucaagacgcccaauacacaaauaacaggggaaagagcauucuuuucguguggggcauacaucacccacccaccuauaccgaacaaacaaauuuguacauaagaaacgacacaacaacaagcgugacaacagaagauuugaauaggaccuucaaaccagugauagggccaaggccccuugucaauggucugcagggaagaauugauuauuauuggucgguacuaaaaccaggccaaacauugcgaguaagauccaaugggaaucuaauugcuccaugguauggacacguucuuucaggagggagccauggaagaauccugaagacugauuuaaaaagugguaauuguguagugcaaugucagacugaaaaagguggcuuaaacaguacauugccauuccacaauaucaguaaauaugcauuuggaaccugccccaaauauguaagaguuaauagucucaaacuggcagucggucugaggaacgugccugcuagaucaaguagaggacuauuuggagccauagcuggauucauagaaggagguuggccaggacuagucgcuggcugguaugguuuccagcauucaaaugaucaagggguugguauggcugcagauagggauucaacucaaaaggcaauugauaaaauaacauccaaggugaauaauauagucgacaagaugaacaagcaauaugaaauaauugaucaugaauucagugagguugaaacuagacucaauaugaucaauaauaagauugaugaccaaauacaagacguaugggcauauaaugcagaauugcuaguacuacuugaaaaucagaaaacacucgaugagcaugaugcgaacgugaacaaucuauauaacaaggugaagagggcacugggcuccaaugcuauggaagaugggaaaggcuguuucgagcuauaccauaaaugugaugaucagugcauggaaacaauucggaacgggaccuauaauaggagaaaguauagagaggaaucaagacuagaaaggcagaaaauagaggggguuaagcuggaaucugagggagcuuacaaaauccucaccauuuauucgacugucgccucaucucuugugcuugcaaugggguuugcugccuuccuguucugggccauguccaauggaucuugcagaugcaacauuuguauauaa

SEQ ID NO: 44327 - RNA, 1707 nt, Artificial Sequence
  hemagglutinin__InfluenzaA__CBW54815
auggagaaaauagugcuucuucuugcaauagucagucuuguuaaaagugaucagauuugcauugguuaccaugcaaacaacucaacagagcagguugacacaauaauggaaaagaacgucacuguuacacacgcucaagacauacuggaaaagacacacaacgggaaacucugcgaucuagauggagugaagccucuaauuuuaagagauuguaguguagcuggauggcuccucgggaacccaaugugugacgaauuccccaaugugucggaaugguccuacauaguggagaagaccaauccagccaaugaccucuguuacccagggaauuucgacaacuaugaagaacugaaacaccuauugagcagaauaaaccgguuugagaaaauucagaucauccccaaaaguucuuggccagaucaugaagccucauuaggagugagcucagcauguccauaccagggaggacccuccuuuuauagaaaugugguauggcuuaucaaaaagaacaauacauacccaacaauaaaggaaaguuaccauaauaccaaucaagaagaucuuuuggugcugugggggauccaccauccaaaugaugaggaagagcagacaagaaucuauaaaaacccaacuaccuauauuuccguugggacaucaacacuaaaccagagauugguaccaaagauagccacuagaucuaagguaaacgggcaaaguggaagaguggaguucuuuuggacaauuuuaaaaucaaaugauacaauaaacuuugagaguaauggaaauuucauugcuccagaaaaugcauacaaaauugucaagaaaggggacucaacaauuaugaaaagugaguuggaauaugguaacugcagcaccaaaugucaaacuccaauaggggcgauaaacuccaguaugccauuccacaacauccacccucucaccaucggggaaugccccaaauaugugaaaucaaacagauuaguccuugcuacugggcucagaaauagcccucaaggagagggaagaagaaaaaagagaggacuauuuggagcuauagcagguuuuauagagggaggauggcagggaaugguagaugguugguauggguaccaccauagcaacgagcaggggaguggguacgcugcagacaaggaauccacucaaaaggcaauagauggagucaccaauaaggucaacucaaucauugacaaaaugaauacucaguuugaggcuguugggagggaauuuaauaacuuggaaaagagaauagaaaauuuaaacaagaagauggaagacggguuccuagaugucuggacuuauaaugcugaacuucugguucucauggaaaaugagagaacucuagacuuucaugacucaaaugucaagaaccuuuacgacaaggugcgacuacagcuuagggacaaugcaaaggagcuugguaacgguuguuucgaguucuaucacagaugcgauaaugaauguauggaaaguguaagaaacggaacguaugacuacccgcaguauucagaagaagcaagauuaaaaagagaggaaauaaguggaguaaaauuggaaucaauaggaacuuaccaaauacuaucaauuuacucaacaguggcaaguucccuagcacuggcaaucaugguggcuggucuauuuuuauggaugugcuccaauggaucguuacaaugcagaauuugcauuuaa

SEQ ID NO: 44328 - RNA, 1707 nt, Artificial Sequence
  hemagglutinin__InfluenzaA__CBW54817
auggagaaaauagugcuucuucuugcaauagucagucuuguuaaaagugaucagauuugcauugguuaccaugcaaacaacucaacagagcagguugacacaauaauggaaaagaacgucacuguuacacacgcucaagacauacuggaaaagacacacaaugggaaacucugcgaucuagauggagugaagccucuaauuuuaagagauuguaguguagcuggauggcuccucgggaacccaaugugugacgaauuccccaaugugucggaaugguccuacauaguggagaagaucaauccagccaaugaccucuguuacccagggaauuucaacaacuaugaagaacugaaacaccuauugagcagaauaaaccguuuugagaaaauucagaucauccccaaaaguucuuggccagaucaugaagccucauuaggagugagcucagcauguccauaccagagaggacccuccuuuuauagaaaugugguauggcuuaucaaaaagaacgauacauacccaacaauaaaggaaaguuaccauaauaccaaucaagaagaucuuuuggugcugugggggauccaccauccaaaugaugaggaagagcagaaaaggaucuauaaaaacccaacuaccuauauuuccguugggacaucaacacuaaaccagagauugguaccaaagauagccacuagaucuaagguaaacgggcaaaguggaagaguggaguucuuuuggacaauuuuaaaaucaaaugauacaauaaacuuugagaguaauggaaauuucauugcuccagaaaaugcauacaaaauugucaagaaaggggacucaacaauuaugaaaagugaguuggaauaugguaacugcagcaccaagugucaaacuccaauaggggcgauaaacaccaguaugccauuccacaacauccacccucucaccaucggggaaugccccaaauaugugaaaucaaacagauuaguccuugcuacugggcuuagaaauagcccucaaggagagggaagaagaaaaaagagaggacuauuuggagcuauagcagguuuuauagagggaggauggcagggaaugguagaugguugguauggguaccaccauaguaacgagcaggggaguggguacgcugcagacaaagaauccacucaaaaggcaauagauggagucaccaauaaggucaacucgaucauugacaaaaugaauacucaguuugaggcuguugggagggaauuuaauaacuuggaaaagagaauagaaaauuuaaacaagaagauggaagacggguuccuagaugucuggacuuauaaugcugaacuucugguucucauggaaaaugagagaacucuagacuuucaugacucaaaugucaggaaccuuuacgacaaggugcgacuacagcuuagggacaaugcaaaggagcuugguaacgguuguuucgaguucuaucacagaugcgauaaugaauguauggaaaguguaagaaacggaacguaugacuacccgcaguauucagaagaagcaagauuaaaaagagaggaaauaaguggaguaaaauuggaaucaauaggaacuuaccaaauacuaucaauuuauucaacaguggcaaguucccuagcacuggcaaucaugguggcuggucuauuuuuauggaugugcuccaauggaucguuacaaugcagaauuugcauuuga

SEQ ID NO: 44329 - RNA, 1707 nt, Artificial Sequence
  hemagglutinin__InfluenzaA__CBW54818
auggagaaaauagugcuucuucuugcaauagucagucuuguuaaaagugaucagauuugcauugguuaccaugcaaacaacucaacagagcagguugacacaauaauggaaaagaacgucacuguuacacacgcucaagacauacuggaaaagacacacaacgggaaacucugcgaucuagauggagugaagccucuaauuuuaagagauuguaguguagcuggauggcuccucgggaacccaaugugugacgaauuccccaaugugucggaaugguccuacauaguggagaagaccaauccagccaaugaccucuguuacccagggaauuucaacaacuaugaagagcugaaacaccuauugagcagaauaaaccgguuugagaaaauuaagaucauccccaaaaguucuuggccagaucaugaagccucauuaggagugagcucagcauguccauaccagggaggacccuccuuuuauagaaaugugguauggcuuaucaaaaagaacaauacauacccaacaauaaaggaaaguuaccauaauaccaaucaagaagaucuuuuggugcugugggggauccaccauccaaaugaugaggaagagcagacaaggaucuauaaaaacccaacuaccuauauuuccguugggacaucaacacuaaaccagagauugguaccaaagauagccacuagaucuaagguaaacgggcagaguggaagaguggaguucuuuuggacaauuuuaaaaucaaaugauacaauaaacuuugagaguaauggaaauuucauugcuccagaaaaugcauacaaaauugucaagaaaggggacucaacaauuaugaaaagugaguuggaauaugguaacugcagcaccaagugucaaacuccaguaggggcgauaaacuccaguaugccauuccacaacauccacccucucaccaucggggaaugccccaaauaugugaaaucaaacagauuaguccuugcuacugggcucaggaauagcccucaaggagagggaagaagaaaaaagagaggacuauuuggagcuauagcagguuuuauagagggaggauggcagggaaugguagaugguugguauggguaccaccauagcaacgagcaggggaguggguacgcugcagacagagaauccacucaaaaggcaauagauggagucaccaauaaggucaacucaaucauugacaaaaugaauacucaguuugaggcuguuggaagggaauuuaauaacuuggaaaagagaauagaaaauuuaaacaagaagauggaagacggguuucuagaugucuggacuuauaaugcugaacuucugguucucauggaaaaugagagaacucuagacuuucaugacucaaaugucaagaaccuuuacgacaaggugcgacuacagcuuagggacaaugcaaaggagcuugguaacgguuguuucgaguucuaucacagaugcgauaaugaauguauggaaaguguaagaaacggaacguaugacuacccgcaguauucagaagaagcaagauuaaaaagagaggaaauaaguggaguaaaauuggaaucaauaggaacuuaccaaauacuaucaauuuauucaacaguggcaaguucccuagcacuggcaaucauaguggcuggucuacuuuuauggaugugcuccaauggaucguuacaaugcagaauuugcauuuaa

SEQ ID NO: 44330 - RNA, 1701 nt, Artificial Sequence
  hemagglutinin__InfluenzaA__CCG47908
augaagacugucauugcuuuaagcuacgucuuuugucuggguuuuggccaaggucuuccaggaaagggcaacaacacagcaacacugugccugggacaucaugcagugccaaauggaacacuagugaaaacaaucacagaugaucagaucgaaguaaccaaugcuacagaacugguucagaauuucucaauggguaaaauaugcaagaauccucaucgaauucuugauggggcaaauugcacacugauagacucucuauugggggacccucauugugaugguuuucaagaugagaaaugggaccuuuucauugaacgcagcaaggcuuucagcaacuguuacccuuaugaugugccggaguauaccucccuuaggucaauaauugccucgucaggcaccuuggaauuuaccaaugaagauuucaauuggacuggggucacccagaauggaggaagcagugcuugcaagagggggccuaacaacagcuuuuucaguaggcugaacuggcuguacaaaucggguaacacauauccgaugcuaaauguuacuaugccaaacagugaugauuuugacaaauuguacauuugggggguucaucauccgaguaccgauagagaacagaccaaccuguauauucaagcaucagggaaaauaauaguuucuacaaagagaagucaacaaaccauaaucccgaauaucgggucuagacccuggguaagggguuugucuaguaggauaagcaucuacuggacaauaguuaaaccaggggacauccugauaaucaacagcaauggaaaccuaauugcuccucgagguuacuucaaaauacagacugggaaaagcucaguaaugagaucagaugcaccuauugacaccugcaauucugaaugcauuacuccaaacggaagcauacccaaugacaaaccuuuucaaaacguaaacaggaucacauauggggcaugucccaaauacaucaagcaaaacacucugaaguuggcaacagggaugcggaauauaccagaaagacaaacuagagguauauucggugcaauagcaggguucauagagaaugguugggaaggaauggugaacgguugguacgguuucaggcaccaaaauucugagggcauaggacaagcagcagaucuuaaaaguacccaagcagcuaucaaccaaaucaaugggaaacugaauagaguaaucgagaagacgaacgagaaauuccaucaaaucgaaaaggaguucucagaaguagaaggaagaauccaagaccucgaaagauauguugaagauacuaagauagaucuuuggucuuacaacgcggaacuucuugucgcgcuagagaaucaacacacaauugaccugacugacucagaaaugaacaaacucuuugaaaaaacaagaaaacaacugagggaaaaugcugaggauaugggaaaugguugcuucaaaauauaccacaaaugugacaacucuugcauggagucaaucagaaauggaacuuacgaccauaacgaauacagagacgaagcaguaaacaaccgauuucagaucaaaaguguugagcugaagucaggauacaaagacuggauccuguggauuuccuuugccauaucaugcuuuuugcuuugugcuguuuggcugggauucauaauaugggccugccagaaaggcaacauuaggugcaacauuugcaucuga

SEQ ID NO: 44331 - RNA, 1701 nt, Artificial Sequence
  hemagglutinin_precursor_(high_yield_phenotype)__InfluenzaA_ _AAB39851
augaaggcaauacuauuagucuuguuauguacauuugcagccacaaaugcagacacacuauguauagguuaucaugcaaauaauucaacugacacuguugauacaguacuagaaaagaauguaacaguaacacacucuguuaaucuucuugaagacagacauaacgggaaacuauguaaacugggggggauagccccauugcacuuggguaaauguaacauugccgguaggcuuuugggaaacccagaaugugaauuacuacucacaguaagcucauggucuuacauuguggaaacaucgaaaucagacaaugggacauguuacccaggagauuucaucaauuaugaagagcugagagagcaguugagcucagugucaucauuugaaagauucgagauauuccccaagacaaguucguggcccaaucaugaaacaaacagaggugugacggcagcaugcccuuaugcuggagcaaacagcuucuacagaaauuuaauauggcuggugaaaaaagaaaauucauacccaaagcucagcaaauccuauguuaacaauaaagggaaggaaguccuugugcuauggggcauucaucauccaccuaccaguacugaucaacaaagucucuaccaaaaugcagaugccuauguuuuuguagggucaucaaaauauaacagaaaguucaagccagaaauagcagcaagacccaaggugagaggucaagcagggaggaugagcuauuacuggacacuaauagaaccuggagacacaauaacauuugaagcaacuggaaaucuagugguaccaagauaugcuuucgcaaugaauagagguucuggaucugguauuauaauuugggaugcaccaguucaugauuguaacacgaagugucaaacacccaagggugccauaaacaccagccucccauuucagaauauacauccagucacaauuggagaauguccaaaauaugucaaaagcacaaaauugagaauggcuacaggacuaaggaaugucccgucuauucaaucuagaggucuguuuggagccauugcugguuuuauugaggggggauggacaggaaugauagauggaugguaugguuaucaccaucagaaugaacagggaucaggauaugcagcggaccaaaggagcacacaaaaugccauugacgggaucacuaacaaaguaaauucuguuauugaaaagaugaacacgcaauucacggcaguggguaaagaauucaaccacuuggaaaaaagaauagagaauuuaaacaaaaagguugaugaugguuuucuggauauuuggacauacaaugcagaacuguugguucuauuggaaaaugaaagaacucuggauuuccacgacucgaauguaaagaaccuguaugagaaaguaagaagccagcuaaggaacaaugccaaagaaauuggaaauggcugcuuugaauucuaucacaaaugugaugauacaugcauggagagcgucaaaaaugggacuuaugauuacccaaaguacucagaagaaucaaagcuaaacagagaggagauagauggaguaaaguuggagucaacaagaauuuaccagauuuuggcgaucuauucaacugucgccaguucauugguacuguuggucucccugggggcaaucaguuuuuggaugugcucuaaugggucuuuacagugcagaauauguauuuaa

SEQ ID NO: 44332 - RNA, 1701 nt, Artificial Sequence
  hemagglutinin_precursor__InfluenzaA__AAA43178
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggauucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagagaugggcaaugguugcuucaaaauauaccacaaaugugacaacgcuugcauagagucaaucagaaaugguacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 44333 - RNA, 1689 nt, Artificial Sequence
  hemagglutinin_precursor__InfluenzaA__AAA43185
auggccaucauuuaucucauucuccuguucacagcagugagaggggaccagauaugcauuggauaccaugccaauaauuccacagagaaggucgacacaaaucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauuuuucaggaacauggucuggcugacaaaggaaggaucagauuauccgguugccaaaggaucguacaacaauacaagcggagaacaaaugcuaauaauuuggggggugcaccaucccauugaugagacagaacaaagaacauuguaccagaaugugggaaccuauguuuccguaggcacaucaacauugaacaaaaggucaaccccagaaauagcaacaaggccuaaagugaauggacaaggagguagaauggaauucucuuggacccucuuggauaugugggacaccauaaauuuugagaguacugguaaucuaauugcaccagaguauggauucaaaauaucgaaaagagguaguucagggaucaugaaaacagaaggaacacuugagaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccaaggaucaggguaugcagcagacaaagaauccacucaaaaggcauuugauggaaucaccaacaagguaaauucugugauugaaaagaugaacacccaauuugaagcuguugggaaggaauucgguaacuuagagagaagacuggagaacuugaacaaaaggauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 44334 - RNA, 1701 nt, Artificial Sequence
  hemagglutinin_precursor__InfluenzaA__AAA43187
augaagaccauuauugcuuugagccacauuuucugucugguucucggccaauaccuuccaggaaaugacaacagcacagcaacgcugugucugggacaucaugcagugccaaacggaacacuagugaaaacaaucacaaaugaucagauugaagugacuaaugcuacugagcuaguucagagcuccucaacggggaaaauaugcaacaauccucaucgaauccuugauggaauagacugcacacugauagaugcucuauugggggacccucauugugaugguuuucaaaaugagacaugggaccuuuucguugaacgcagcaaagcuuucagcaacuguuaccccuaugaugugccagauuaugccucccuuagaucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucagaaagcacauauccagugcugaacgugacuaugccaaacaaugacaauuuugacaaacuauacauuuggggaguucaccacccgagcacgaaccaagaacaaaccagccuguauguucaagcaucagggagagucacagucucuaccaggagaagccagcaaacuauaaucccgaauaucgggucuagacccuggguaaggggucugucuaguagaauaagcaucuauuggacaauaguuaagcccggggacguacugguaauuaauaguaaugcgaaccuaaucgcuccucgggguuauuucaaaaugcgcacugggaaaagcucaauaaugaggucagaugcaccuauugauaccuguauuucugaaugcaucacuccaaauggaagcauucccaacgacaagcccuuucaaaacguaaacaagaucacauauggagcaugccccaaguauguuaagcaaaacacccugaaguuggcaacacggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaucaaaucaaugggaaauugaacaggguaaucgagaagacaaacgagaaauuccaucaaaucgaaaaggaauucucagaaguagaagggagaauucaggaccucgagaaauacguugaagacacuaaaauagaucucuggucuuacaaugcagagcuucuugucgcucuggagaaucaacauacaauugaucugacugacucggaaaugaacaagcuguuugaaaaaacaaggaggcaacugagggaaaaugcugaagacaugggcaaugguugcuucaaaauauacgacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucauguuuuuugcuuuguguuguuuugcugggguucaucaugugggccugccagagaggcaacauuaggugcaacauuugcauuuga

SEQ ID NO: 44335 - RNA, 1698 nt, Artificial Sequence
  hemagglutinin_precursor__InfluenzaA__AAA43209
augaaggcaaaacuacugguccuguuauaugcauuuguagcuacagaugcagacacaauauguauaggcuaccaugcgaacaacucaaccgacacuguugacacaauauucgagaagaauguggcagugacacauucuguuaaccugcucgaagacagacacaacgggaaacuauguaaauuaaaaggaauagccccacuacaauuggggaaauguaacaucaccggauggcucuugggaaauccagaaugcgacucacugcuuccagcgagaucaugguccuacauuguagaaacaccaaacucugagaauggagcauguuauccaggagauuucaucgacuaugaggaacugagggagcaauugagcucaguaucaucauuagaaagauucgaaauauuucccaaggaaaguucauggcccaaccacacauucaacggaguaacaguaucaugcucccauaggggaaaaagcaguuuuuacagaaauuugcuauggcugacgaagaagggggauucauacccaaagcugaccaauuccuaugugaacaauaaagggaaagaaguccuuguacuaugggguguucaucacccguccagcagugaugagcaacagagucucuauaguaauggaaaugcuuaugucucuguagcgucuucaaauuauaacaggagauucaccccggaaauagcugcaaggcccaaaguaaaagaucaacaugggaggaugaacuauuacuggaccuugcuagaacccggagacacaauaauauuugaggcaacugguaaucuaauagcaccaugguaugcuuucgcacugaguagaggguuugaguccggcaucaucaccucaaacgcgucaaugcaugaguguaacacgaagugucaaacaccccagggaucuauaaacagcaaucucccuuuccagaauauacacccagucacaauaggagagugcccaaaauaugucaggaguaccaaauugaggaugguuacaggacuaagaaacaucccauccauucaauacagaggucuauuuggagccauugcugguuuuauugaggggggauggacuggaaugauagauggaugguaugguuaucaucaucagaaugaacagggaucaggcuaugcagcggaucaaaaaagcacacagaaugccauuaacgggauuacaaacaaggugaacucuguuaucgagaaaaugaacacucaauucacagcuguggguaaagaauucaacaacuuagaaaaaaggauggaaaauuuaaauaaaaaaguugaugauggguuucuggacauuuggacauauaaugcagaauuguuaguucuacuggaaaaugaaagaacuuuggauuuccaugacuuaaaugugaagaaucuguacgagaaaguaaaaagccaauuaaagaauaaugccaaagaaaucggaaauggguguuuugaguucuaccacaagugugacaaugaaugcauggaaaguguaagaaaugggacuuaugauuauccaaaauauucagaagaaucaaaguugaacagggaaaagauagauggagugaaauuggaaucaauggggguguaucagauucuggcgaucuacucaacugucgccaguucacuggugcuuuuggucucccugggggcaaucaguuucuggauguguucuaaugggucuuugcagugcagaauaugcaucuga

SEQ ID NO: 44336 - RNA, 1683 nt, Artificial Sequence
  hemagglutinin_precursor__InfluenzaA__AAC40998
augaacacucaaauccugauacucgcucuuguggcgaucaucccaacaaaugcagacaaaaucugccuugggcaucaugccgugucaaacggggcuaaaguaaacacauuaacugaaagaggaguggaagucguuaaugcaacugaaacgguggaacgaacaaauguccccaggaucugcucaaaagggaaaaggacaguugaccucggucaauguggacuucugggaacaaucacugggccaccccaaugugaccaauuccuagaauuuucagccgauuuaauuauugaaagacgggaaggaaaugaugucuguuauccugggaaauuugugaaugaagaagcucugaggcaaauucucagaaaaucaggcggaauugauaaggagacaaugggauucacauacagcggaauaagaacuaauggagcaaccagugcauguaggagaucaggaucuucauucuaugcugagaugaaauggcuucugucaaacacagacaacgcugcuuucccgcagaugacuaagucauacaaaaacauaaggaaagacccagcucugauaauauggggaauccaucauuccggaucaacugcagagcagaccaaguuauaugggaguggaaacaaacuaauaacagucgggaguuccaauuaucaacagucuuucguaccgaguccgggagcgagaccacaagugaauggccaaucuggaaggauugacuuucauuggcugaugcuaaaccccaaugacacagucacuuucaguuucaauggggcuuucauagcuccagaccgugcaaguuuucugagaggaaaguccaugggaauucagagugagguacagguugaugccaauugugaaggagauugcuaucauaguggagggacaauacuaaguaguuugccuuuucagaacaucaauagcagaacaguaggggaauguccgagguauguuaagcaagaaagucugcuauuggcaacagggaugaagaacguuccugagauuccaaaaggaagaggccuauuuggugccauagcggguuucauugaaaauggaugggaaggucugguugauggaugguauggcuucaggcaucaaaaugcacaaggggagggaacugcugcagauuacaagagcacccaaucggcaauugaucaaauaacagggaaauuaaaccgucuuauagagaaaacuaaucaacaauuugaguugauagacaaugaauucacugagguugaaaagcaaauuggcaaugugauaaauuggacuagagauuccuugacagaaaugugguccuauaaugcugaacucuugguagcaauggagaaucagcacacaaucgaucuggccgacucagaaaugaacaaacuauaugaacgagugaggagacaauugagagaaaaugcugaggaagauggcacugguugcuucgaaauauuccacaagugugaugaugacuguauggccagcauuaggaauaacaccuaugaucacagcaaguacagagaagaagcaauacaaaauagaauacagauugacccagucaaacuaagcagcggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 44337 - RNA, 1683 nt, Artificial Sequence
  hemagglutinin_precursor__InfluenzaA__AAC40999
augaacacucaaauccugauacucgcucuuguggcgaucaucccaacaaaugcagacaaaaucugccuugggcaucaugccgugucaaacgggaccaaaguaaacacauuaacugaaagaggaguggaagucguuaaugcaacugaaacgguggaacgaacaaacguccccaggaucugcucaaaagggaaaagaacaguugaccucggucaauguggacuucugggaacaaucacugggccaccccaaugugaccaauuccuagaauuuucagccgauuuaauuauugaaagacgagaaggagaugaugucuguuauccugggaaauuugugaaugaagaagcucugaggcaaauucucagggaaucaggcgggauugauaaggagacaaugggauucacauacagcggaauaagaacuaauggagcaaccagugcauguaggagaucaggaucuucauucuaugcugagaugaaauggcuucugucaaacacagacaaugcugccuucccgcagaugacuaagucauacaaaaacauaaggaaagacccagcucugauaauauggggaauccaucauucuggaucaacugcagagcagaccaaguuauaugggaguggaaacaaacuaauaacagucgggaguuccaauuaucaacagucuuuuguaccgauuccaggagcgagaccacaagugaauggccaaucuggaaggauugacuuucauuggcugaugcuaaaccccaaugacaccgucacuuucaguuucaauggggcuuucauagcuccagaccgugcgaguuuucugagaggaaaguccaugggaauucagagugagguacagguugaugccaauugugaaggagauugcuaucauaguggagggacaauacuaaauaauuugccuuuucagaauaucaauggcagagcaguagggaaauguccgagguauguuaagcaagaaagucugcuacuggcaacagggaugaagaacguuccugagauuccaaaaggaagaggccuauuuggugccauagcggguuucauugaaaauggaugggaaggucugguugauggaugguauggcuucaggcaucaaaaugcacaaggggagggaacugcugcagauuacaagagcacccaaucggcaauugaucaaauaacagggaaguuaaaccgucuuauagagaaaacuaaucaacaauuugaguugauagacaaugaauucacugagguugaaaagcaaauuggcaaugugauaaauuggaccagagauuccaugacagaggugugguccuauaaugcugaacucuugguagcaauggagaaucagcacacaaucgaucuggccgacucagaaaugaacaaacuauaugaacgaguaaggagacaauugagagagaaugcugaggaagauggcacugguugcuucgaaauauuccacaagugugaugacgacuguauggccagcauuaggaauaacaccuaugaucacagcaaguacagagaagaagcaauacaaaauagaauacagauugacccagucaaacugagcagcggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 44338 - RNA, 1698 nt, Artificial Sequence
  hemagglutinin__InfluenzaA__ACA28844
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaauuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuuacaguguagaauaugcaucuaa

SEQ ID NO: 44339 - RNA, 1698 nt, Artificial Sequence; identical to SEQ ID NO: 38297
  hemagglutinin__InfluenzaA__ACA28844/m1

SEQ ID NO: 44340 - RNA, 1701 nt, Artificial Sequence; identical to SEQ ID NO: 39654
  hemagglutinin__InfluenzaA__ACV82259

SEQ ID NO: 44341 - RNA, 1701 nt, Artificial Sequence
  hemagglutinin__InfluenzaA__ACV82259/m1
augaaggcaauacugguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucggacaaagguguaacggcagcauguccucaugcuggagcaaagagcuucuacaaaaauuuaauauggcuaguuaaaaaaggaaauucauacccaaagcucagcaaauccuacauuaaugauaaagggaaagaaguccucgugcuauggggcauucaccauccaucuaccagugcugaccaacaaagucucuaucagaaugcagaugcauauguuuuuguggggucaucaagauacagcaagacguucaagccggaaauagcaauaagacccaaagugagggaucgagaagggagaaugaacuauuacuggacacugguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44342 - RNA, 1701 nt, Artificial Sequence
  hemagglutinin__InfluenzaA__ACV82259/m2
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucggacaaagguguaacggcagcauguccucaugcuggagcaaagagcuucuacaaaaauuuaauauggcuaguuaaaaaaggaaauucauacccaaagcucagcaaauccuacauuaaugauaaagggaaagaaguccucgugcuauggggcauucaccauccaucuaccagugcugaccaacaaagucucuaucagaaugcagaugcauauguuuuuguggggucaucaagauacagcaagacguucaagccggaaauagcaauaagacccaaagugagggaucgagaagggagaaugaacuauuacuggacacugguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44343 - RNA, 1701 nt, Artificial Sequence; identical to SEQ ID NO: 33171
  hemagglutinin__InfluenzaA__ACP41953

SEQ ID NO: 44344 - RNA, 1701 nt, Artificial Sequence; identical to SEQ ID NO: 42745
  hemagglutinin__InfluenzaA__AFM72832

SEQ ID NO: 44345 - RNA, 1701 nt, Artificial Sequence
  hemagglutinin__InfluenzaA__EPI516528
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacacuguagaauauguguuuaa

SEQ ID NO: 44346 - RNA, 1701 nt, Artificial Sequence
  hemagglutinin__InfluenzaA__AGM53850
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44347 - RNA, 1701 nt, Artificial Sequence
  hemagglutinin__InfluenzaA__EPI731463
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaauacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44348 - RNA, 1701 nt, Artificial Sequence; identical to SEQ ID NO: 35002
  hemagglutinin__InfluenzaA__EPI696972

SEQ ID NO: 44349 - RNA, 1701 nt, Artificial Sequence
  hemagglutinin__InfluenzaA__EPI662594
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuggaagacaagcauaacggaaaacuaugcaaacuaagagggguagccccauugcauuuggguaaauguaacauugcuggcuggauccugggaaauccagagugugaaucacucuccacagcaaguucaugguccuacauuguggaaacaucuaauucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaacuugauauggcuaguuaaaaaaggaaauucauacccaaagcuuaaccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaacaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaauguuccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaaucuaaauaaaaaaguugaugaugguuuccuggacauuuggacuuacaaugccgaacuguugguucuauuggaaaaugaaagaacuuuggacuaucacgauucaaaugugaagaacuuguaugaaaaaguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 44350 - RNA, 1701 nt, Artificial Sequence
  hemagglutinin__InfluenzaA__EPI685579
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuggaagacaagcauaacggaaaacuaugcaaacuaagagggguagccccauugcauuuggguaaauguaacauugcuggcuggauccugggaaauccagagugugaaucacucuccacagcaaguucaugguccuacauuguggaaacaucuaauucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaacuugauauggcuaguuaaaaaaggaaauucauacccaaagcuuaaccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaacaagacccaaagugagggaucgagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaauguuccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaaucuaaauaaaaaaguugaugaugguuuccuggacauuuggacuuacaaugccgaacuguugguucuauuggaaaaugaaagaacuuuggacuaucacgauucaaaugugaagaacuuguaugaaaaaguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 44351 - RNA, 1701 nt, Artificial Sequence
  hemagglutinin__InfluenzaA__EPI830230
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuggaagacaagcauaacggaaaacuaugcaaacuaagagggguagccccauugcauuuggguaaauguaacauugcuggcuggauccugggaaauccagagugugaaucacucuccacagcaaguucaugguccuacauuguggaaacaucuaauucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaacuugauauggcuaguuaaaaaaggaaauucauacccaaagcuuaaccaauccuacauuaaugauaaagggaaagaaguccucgugcuguggggcauucaccauccaucuacuacugcugaccaacaaagucucuaucagaaugcagaugcauauguuuuuguggggacaucaagauacagcaagauguucaagccggaaauagcaacaagacccaaagugagggaucgagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaauguuccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaaucuaaauaaaaaaguugaugaugguuuccuggacauuuggacuuacaaugccgaacuguugguucuauuggaaaaugaaagaacuuuggacuaucacgauucaaaugugaagaacuuguaugaaaaaguaagaaaccaguuaaaaaacaaugccaaggaaauuggaaacggcugcuuugaauuuuaccacaaaugcgauaacacgugcauggaaagugucaaaaauggaacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 44352 - RNA, 1701 nt, Artificial Sequence; identical to SEQ ID NO: 33168
  hemagglutinin__InfluenzaA__ACQ45338

SEQ ID NO: 44353 - RNA, 1701 nt, Artificial Sequence
  hemagglutinin__InfluenzaA__ACQ45338/m1
augaaggcaauacucguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaagagcuucuacaaaaauuuaauauggcuaguuaagaaaggaaauucauacccaaagcucagcaaauccuacauuaaugauaaagggaaagaaguccucgugcuauggggcauucaccauccaucuaccagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacccuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggcggguggacagggaugguagauggaugguacgguuaucaccaucaaaaugagcaggggucaggauaugcagccgaccucaagagcacacagaaugccauugacgagauuacuaacaaaguaaauucuguuauugaaaagaugaauacacaguucacagcaguagguaaagaguucaaccaccuggaaaagagaauagagaauuuaaauaagaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaagaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44354 - RNA, 1701 nt, Artificial Sequence
  hemagglutinin__InfluenzaA__ACQ45338/m2
augaaggcaauacugguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44355 - RNA, 1701 nt, Artificial Sequence; identical to SEQ ID NO: 32823
  hemagglutinin__InfluenzaA__ACU79871

SEQ ID NO: 44356 - RNA, 1701 nt, Artificial Sequence
  hemagglutinin__InfluenzaA__ACU79871/m1
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucgaguccagacccuggguaaggggucagucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaagugaacaggauaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaagugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 44357 - RNA, 1701 nt, Artificial Sequence
  hemagglutinin__InfluenzaA__EPI643118
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuucccguaugcucaaucaucaggaagaaucauaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaacuacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44358 - RNA, 1701 nt, Artificial Sequence; identical to SEQ ID NO: 42945
  hemagglutinin__InfluenzaA__EPI675798

SEQ ID NO: 44359 - RNA, 1701 nt, Artificial Sequence
  hemagglutinin__InfluenzaA__EPI578430
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcagcuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuucccguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44360 - RNA, 1701 nt, Artificial Sequence
  hemagglutinin__InfluenzaA__EPI614406
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcagcuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuucccguaugcucaaucaucaggaagaaucacaguaucuaccaaaagaagccaacaagcuguaaucccaaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44361 - RNA, 1695 nt, Artificial Sequence
  hemagglutinin__InfluenzaA__ACU65077/m1
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagacacacaaugggaagcucugcgaucuagauggagugaagccucuaauuuugagagauuguaguguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauugggggugagcucagcauguccauaccagggaaaguccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaaaccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuagcaugccauuccacaauauacacccucucaccaucggggaaugccccaaauaugugaaaucaaacagauuaguccuugcgacugggcucagaaauagcccucaacgagagacgcgaggauuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgauuauugacaaaaugaacacucaguuugaggccguuggaagggaauuuaacaacuuagaaaggagaauagagaauuuaaacaagaagauggaagacggguuccuagaugucuggacuuauaaugcugaacuucuaguucucauggaaaacgagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaacggaacguaugacuacccgcaguauucagaagaagcaagacuaaaaagagaggaaauaaguggaguaaaauuggaaucaauaggaauuuaccaaauauugucaauuuauucuacaguggcgagcucccuagcacuggcaaucaugguagcuggucuauccuuauggaugugcuccaaugggucguuacaaugcagaauuugcauuuaa

SEQ ID NO: 44362 - RNA, 1695 nt, Artificial Sequence
  hemagglutinin__InfluenzaA__ACU65077/m2
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagacacacaaugggaagcucugcgaucuagauggagugaagccucuaauuuugagagauuguaguguagcuggauggcuccucggaaacccaaugugugacgaauuuaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauugggggugagcucagcauguccauaccagggaaaguccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaaaccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuagcaugccauuccacaauauacacccucucaccaucggggaaugccccaaauaugugaaaucaaacagauuaguccuugcgacugggcucagaaauagcccucaacgagagacgcgaggauuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgauuauugacaaaaugaacacucaguuugaggccguuggaagggaauuuaacaacuuagaaaggagaauagagaauuuaaacaagaagauggaagacggguuccuagaugucuggacuuauaaugcugaacuucuaguucucauggaaaacgagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaacggaacguaugacuacccgcaguauucagaagaagcaagacuaaaaagagaggaaauaaguggaguaaaauuggaaucaauaggaauuuaccaaauauugucaauuuauucuacaguggcgagcucccuagcacuggcaaucaugguagcuggucuauccuuauggaugugcuccaaugggucguuacaaugcagaauuugcauuuaa

SEQ ID NO: 44363 - RNA, 1707 nt, Artificial Sequence
  hemagglutinin__InfluenzaA__ABP51976
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagacacacaaugggaagcucugcgaucuagauggagugaagccucuaauuuugagagauuguaguguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauugggggugagcucagcauguccauaccagggaaaguccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucuacacuaaaccagagauugguaccaagaauagcuacuagauccaaaguaaacgggcaaaguggaaggauggaguucuucuggacaauuuuaaaaccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuagcaugccauuccacaauauacacccucucaccaucggggaaugccccaaauaugugaaaucaaacagauuaguccuugcgacugggcucagaaauagcccucaaagagagagaagaagaaaaaagagaggauuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgauuauugacaaaaugaacacucaguuugaggccguuggaagggaauuuaacaacuuagaaaggagaauagagaauuuaaacaagaagauggaagacggguuccuagaugucuggacuuauaaugcugaacuucuaguucucauggaaaacgagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaacggaacguaugacuacccgcaguauucagaagaagcaagacuaaaaagagaggaaauaaguggaguaaaauuggaaucaauaggaauuuaccaaauauugucaauuuauucuacaguggcgagcucccuagcacuggcaaucaugguagcuggucuauccuuauggaugugcuccaaugggucguuacaaugcagaauuugcauuuaa

SEQ ID NO: 44364 - RNA, 1707 nt, Artificial Sequence
  hemagglutinin__InfluenzaA__ABP51976/m1
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagacacacaaugggaagcucugcgaucuagauggagugaagccucuaauuuugagagauuguaguguagcuggauggcuccucggaaacccaaugugugacgaauuuaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauugggggugagcucagcauguccauaccagggaaaguccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucuacacuaaaccagagauugguaccaagaauagcuacuagauccaaaguaaacgggcaaaguggaaggauggaguucuucuggacaauuuuaaaaccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuagcaugccauuccacaauauacacccucucaccaucggggaaugccccaaauaugugaaaucaaacagauuaguccuugcgacugggcucagaaauagcccucaaagagagagaagaagaaaaaagagaggauuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgauuauugacaaaaugaacacucaguuugaggccguuggaagggaauuuaacaacuuagaaaggagaauagagaauuuaaacaagaagauggaagacggguuccuagaugucuggacuuauaaugcugaacuucuaguucucauggaaaacgagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaacggaacguaugacuacccgcaguauucagaagaagcaagacuaaaaagagaggaaauaaguggaguaaaauuggaaucaauaggaauuuaccaaauauugucaauuuauucuacaguggcgagcucccuagcacuggcaaucaugguagcuggucuauccuuauggaugugcuccaaugggucguuacaaugcagaauuugcauuuaa

SEQ ID NO: 44365 - RNA, 1695 nt, Artificial Sequence
  hemagglutinin__InfluenzaA__ABW90125
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagaaacacaacgggaagcucugcgaucuagauggagugaagccucuaauuuugagagauuguagcguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguuauugguccagucaugaagccucauuaggggugagcucagcaugcccauaccagggaaaguccuccuuuuucagaaaugugguauggcuuaccaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaagccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuagcaugccauuccacaauauacacccucucaccauuggggaaugccccaaauaugugaaaucaaacagauuaguccuugcgacugggcucagaaauagcccucaacgagagacgcgaggauuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaacaacuuagaaaggagaauagagaauuuaaacaagaagauggaagacggguuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaauggaacguaugacuacccgcaguauucagaagaagcgagacuaaaaagagaggaaauaaguggaguaaaauuggaaucaauaggaauuuaccaaauacugucaauuuauucuacaguggcgaguucccuagcacuggcaaucaugguagcuggucuauccuuauggaugugcuccaauggaucguuacaaugcagaauuugcauuuaa

SEQ ID NO: 44366 - RNA, 1695 nt, Artificial Sequence
  hemagglutinin__InfluenzaA__ABW90126
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagaaacacaacgggaagcucugcgaucuagauggagugaagccucuaauuuugagagauuguagcguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauuaggggugagcucagcaugcccauaccagggaaaguccuccuuuuucagaaaugugguauggcuuaucaaaaagaacaguacauacccaacaauaaaggggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaagccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuagcaugccauuccacaauauacacccucucaccauuggggaaugccccaaauaugugaaaucaaacagauuaguccuugcgacugggcucagaaauagcccucaacgagagacgcgaggauuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaacaacuuagaaaggagaauagagaauuuaaacaagaagauggaagacggguuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaauggaacguaugacuacccgcaguauucagaagaagcgagacuaaaaagagaggaaauaaguggaguaaaauuggaaucaauaggaauuuaccaaauacugucaauuuauucuacaguggcgaguucccuagcacuggcaaucaugguagcuggucuauccuuauggaugugcuccaauggaucguuacaaugcagaauuugcauuuaa

SEQ ID NO: 44367 - RNA, 1695 nt, Artificial Sequence
  hemagglutinin__InfluenzaA__ABW90127
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagaaacacaacgggaagcucugcgaucuagauggagugaagccucuaauuuugagagauuguagcguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauuaggggugagcucagcaugcccauaccagggagaguccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaagccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuagcaugccauuccacaauauacacccucucaccauuggggaaugccccaaauaugugaaaucaaacagauuaguccuugcgacugggcucagaaauagcccucaacgagagacgcgaggauuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaacaacuuagaaaggagaauagagaauuuaaacaagaagauggaagacggguuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaauggaacguaugacuacccgcaguauucagaagaagcgagacuaaaaagagaggaaauaaguggaguaaaauuggaaucaauaggaauuuaccaaauacugucaauuuauucuacaguggcgaguucccuagcacuggcaaucaugguagcuggucuauccuuauggaugugcuccaauggaucguuacaaugcagaauuugcauuuaa

SEQ ID NO: 44368 - RNA, 1695 nt, Artificial Sequence
  hemagglutinin__InfluenzaA__ABW90128
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagaaacacaacgggaagcucugcgaucuagauggagugaagccucuaauuuugagagauuguagcguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauuaggggugagcucagcaugcccauaccagggaaaguccuccuuuuucagaaaugugguauggcuuaucgaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaagccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuagcaugccauuccacaauauacacccucucaccauuggggaaugccccaaauaugugaaaucaaacagauuaguccuugcgacugggcucagaaauagcccucaacgagagacgcgaggauuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaacaacuuagaaaggagaauagagaauuuaaacaagaagauggaagacggguuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaauggaacguaugacuacccgcaguauucagaagaagcgagacuaaaaagagaggaaauaaguggaguaaaauuggaaucaauaggaauuuaccaaauacugucaauuuauucuacaguggcgaguucccuagcacuggcaaucaugguagcuggucuauccuuauggaugugcuccaauggaucguuacaaugcagaauuugcauuuaa

SEQ ID NO: 44369 - RNA, 1695 nt, Artificial Sequence
  hemagglutinin__InfluenzaA__ABW90129
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagaaacacaacgggaagcucugcgaucuagauggagugaagccucuaauuuugagagauuguagcguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauuaggggugagcucagcaugcccauaccagggaaaguccuccuuuuucagaaaugugguauggcuuaucaaaaagaacagugcauacccaacaauaaagaggagcuacaauaauaccaaccaagaagaucuuuugguacugugggggauucaccauccuaaugaugcggcagagcagacagagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaagccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuagcaugccauuccacaauauacacccucucaccauuggggaaugccccaaauaugugaaaucaaacagauuaguccuugcgacugggcucagaaauagcccucaacgagagacgcgaggauuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaacaacuuagaaaggagaauagagaauuuaaacaagaagauggaagacggguuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaauggaacguaugacuacccgcaguauucagaagaagcgagacuaaaaagagaggaaauaaguggaguaaaauuggaaucaauaggaauuuaccaaauacugucaauuuauucuacaguggcgaguucccuagcacuggcaaucaugguagcuggucuauccuuauggaugugcuccaauggaucguuacaaugcagaauuugcauuuaa

SEQ ID NO: 44370 - RNA, 1695 nt, Artificial Sequence
  hemagglutinin__InfluenzaA__ABW90130
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagaaacacaacgggaagcucugcgaucuagauggagugaagccucuaauuuugagagauuguagcguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauuaggggugagcucagcaugcccauaccagggaaaguucuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaagccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuagcaugccauuccacaauauacacccucucaccauuggggaaugccccaaauaugugaaaucaaacagauuaguccuugcgacugggcucagaaauagcccucaacgagagacgcgaggauuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaacaacuuagaaaggagaauagagaauuuaaacaagaagauggaagacggguuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaauggaacguaugacuacccgcaguauucagaagaagcgagacuaaaaagagaggaaauaaguggaguaaaauuggaaucaauaggaauuuaccaaauacugucaauuuauucuacaguggcgaguucccuagcacuggcaaucaugguagcuggucuauccuuauggaugugcuccaauggaucguuacaaugcagaauuugcauuuaa

SEQ ID NO: 44371 - RNA, 1695 nt, Artificial Sequence
  hemagglutinin__InfluenzaA__ABW90132
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagaaacacaacgggaagcucugcgaucuagauggagugaagccucuaauuuugagagauuguagcguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauuaggggugagcucagcaugcccauaccagggaaaguccuccuuuuucagaaaugugguauggcuuaucaaaaagaacaguacauacccaacaauaaagaggagcuacaauaauaccaaccaagaagaucuuuugguacugugggggauucaccauccuaauaaugcggcagagcagacagagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaagccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuagcaugccauuccacaauauacacccucucaccauuggggaaugccccaaauaugugaaaucaaacagauuaguccuugcgacugggcucagaaauagcccucaacgagagacgcgaggauuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaacaacuuagaaaggagaauagagaauuuaaacaagaagauggaagacggguuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaauggaacguaugacuacccgcaguauucagaagaagcgagacuaaaaagagaggaaauaaguggaguaaaauuggaaucaauaggaauuuaccaaauacugucaauuuauucuacaguggcgaguucccuagcacuggcaaucaugguagcuggucuauccuuauggaugugcuccaauggaucguuacaaugcagaauuugcauuuaa

SEQ ID NO: 44372 - RNA, 1695 nt, Artificial Sequence
  hemagglutinin__InfluenzaA__ABW90133
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagaaacacaacgggaagcucugcgaucuagauggagugaagccucuaauuuugagagauuguagcguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauuaggggugagcucagcaugcccauaccagggaaagcccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaagccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuagcaugccauuccacaauauacacccucucaccauuggggaaugccccaaauaugugaaaucaaacagauuaguccuugcgacugggcucagaaauagcccucaacgagagacgcgaggauuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaacaacuuagaaaggagaauagagaauuuaaacaagaagauggaagacggguuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaauggaacguaugacuacccgcaguauucagaagaagcgagacuaaaaagagaggaaauaaguggaguaaaauuggaaucaauaggaauuuaccaaauacugucaauuuauucuacaguggcgaguucccuagcacuggcaaucaugguagcuggucuauccuuauggaugugcuccaauggaucguuacaaugcagaauuugcauuuaa

SEQ ID NO: 44373 - RNA, 1695 nt, Artificial Sequence
  hemagglutinin__InfluenzaA__ABW90134
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagaaacacaacgggaagcucugcgaucuagauggagugaagccucuaauuuugagagauuguagcguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauuaggggugagcucagcaugcccauaccaggaaaaguccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaagccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuagcaugccauuccacaauauacacccucucaccauuggggaaugccccaaauaugugaaaucaaacagauuaguccuugcgacugggcucagaaauagcccucaacgagagacgcgaggauuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaacaacuuagaaaggagaauagagaauuuaaacaagaagauggaagacggguuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaauggaacguaugacuacccgcaguauucagaagaagcgagacuaaaaagagaggaaauaaguggaguaaaauuggaaucaauaggaauuuaccaaauacugucaauuuauucuacaguggcgaguucccuagcacuggcaaucaugguagcuggucuauccuuauggaugugcuccaauggaucguuacaaugcagaauuugcauuuaa

SEQ ID NO: 44374 - RNA, 1695 nt, Artificial Sequence
  hemagglutinin__InfluenzaA__ABW90135
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagaaacacaacgggaagcucugcgaucuagauggagugaagccucuaauuuugagagauuguagcguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauuaggggugagcucagcaugcccauaccagggaaaguccuccuuuuucagaaaugugguauggcuuaucaacaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaagccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuagcaugccauuccacaauauacacccucucaccauuggggaaugccccaaauaugugaaaucaaacagauuaguccuugcgacugggcucagaaauagcccucaacgagagacgcgaggauuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaacaacuuagaaaggagaauagagaauuuaaacaagaagauggaagacggguuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaauggaacguaugacuacccgcaguauucagaagaagcgagacuaaaaagagaggaaauaaguggaguaaaauuggaaucaauaggaauuuaccaaauacugucaauuuauucuacaguggcgaguucccuagcacuggcaaucaugguagcuggucuauccuuauggaugugcuccaauggaucguuacaaugcagaauuugcauuuaa

SEQ ID NO: 44375 - RNA, 1695 nt, Artificial Sequence
  hemagglutinin__InfluenzaA__HB649491
auggagaagaucgugcugcuguucgccaucgugagccuggugaagagcgaucagaucugcaucggauaccacgccaauaauagcacagagcagguggauacaaucauggagaagaaugugacagugacacacgcccaggauauccuggagaagaaacacaauggaaagcugugcgaucuggauggagugaagccucugauccugagagauugcagcguggccggauggcugcugggaaauccuaugugcgaugaguucaucaaugugccugaguggagcuacaucguggagaaggccaauccugugaaugaucugugcuacccuggagauuucaaugauuacgaggagcugaagcaccugcugagcagaaucaaucacuucgagaagauccagaucaucccuaagagcagcuggagcagccacgaggccagccugggagugagcagcgccugcccuuaccagggcaagagcagcuucuucagaaaugugguguggcugaucaagaagaauagcacauacccuacaaucaagagaagcuacaauaauacaaaucaggaggaucugcuggugcuguggggaauccaccacccuaaugaugccgccgagcagacaaagcuguaccagaauccuacaacauacaucagcgugggaacaagcacacugaaucagagacuggugccuagaaucgccacaagaagcaaggugaauggacagagcggaagaauggaguucuucuggacaauccugaagccuaaugaugccaucaauuucgagagcaauggaaauuucaucgcuccugaguacgccuacaagaucgugaagaagggagauagcacaaucaugaagagcgagcuggaguacggaaauugcaauacaaagugccagacaccuaugggagccaucaauagcagcaugccuuuccacaauauccacccucugacaaucggagagugcccuaaguacgugaagagcaauagacuggugcuggccacaggacugagaaauagcccucagagagagacgagaggacuguucggagccaucgccggauucaucgagggaggauggcagggaaugguggauggaugguacggauaccaccacagcaaugagcagggaagcggauacgccgccgauaaggagagcacacagaaggccaucgauggagugacaaauaaggugaauagcaucaucgauaagaugaauacacaguucgaggccgugggaagagaguucaauaaucuggagagaagaaucgagaaucugaauaagaagauggaggauggauuccuggauguguggacauacaaugccgagcugcuggugcugauggagaaugagagaacacuggauuuccacgauagcaaugugaagaaucuguacgauaaggugagacugcagcugagagauaaugccaaggagcugggaaauggaugcuucgaguucuaccacaagugcgauaaugagugcauggagagcgugagaaauggaacauacgauuacccucaguacagcgaggaggccagacugaagagagaggagaucagcggagugaagcuggagagcaucggaaucuaccagauccugagcaucuacagcacaguggccagcagccuggcccuggccaucaugguggccggacugagccuguggaugugcagcaauggaagccugcagugcagaaucugcaucuga

SEQ ID NO: 44376 - RNA, 1683 nt, Artificial Sequence; identical to SEQ ID NO: 40492
  hemagglutinin__InfluenzaA__EPI439507

SEQ ID NO: 44377 - RNA, 1701 nt, Artificial Sequence
  hemagglutinin__InfluenzaA__EPI482777
augaaagcaauacuaguaguccugcuauauacauuuacaaccgcaaaugccgacacauuauguauagguuaucaugcaaacaauucaacugacaccguagacacaguacuagaaaagaauguaacaguaacacacucugucaaccuucuagaaaacaggcauaaugggaaacuauguaaacuaagagggguagcuccauugcauuuggguaaauguaacauugcuggcuggcuucugggaaauccagagugugaaucacucuccacagcaagcucaugguccuacauuguggaaacaucuaauucagacaaugggacguguuacccaggagauuucaucaauuaugaggagcuaagagagcaguugagcucagugucaucauuugaaagauuugagauauuccccaagacaaguucauggcccaaucaugacacgaacagaggugugacggcagcauguccucaugcuggggcaaacagcuucuacagaaauuuaguauggcuaguaaaaaagggaaauucauacccaaagaucaacaaauccuacauuaacaauaaagagaaggaaguucucgugcuaugggccauucaccauccaucuaccagugccgaccaacaaagucucuaccaaaaugcagaugccuauguguuuguggggucaucaagauacagcaggaaguucgagccagaaauagcaacaagaccuaaggugagagaccaagcagggagaaugaacuauuacuggacacuaguagagccuggugacaagauaacauucgaagcaacuggaaaucuaguggcaccgagauaugccuucgcauugaaaagaaauucuggaucugguauuaucauuucagauacaucaguccacgauugugauacgacuugucagacacccaauggugcuauaaacaccagccucccauuucaaaauauacauccagucacaauuggagaauguccaaaauauguaaaaaguacuaaacugagaauggccacagguuuaaggaauaucccgucuauccaaucuagaggccuguuuggugccauugcuggcuuuaucgaaggggguuggacaggaaugauagauggaugguacgguuaucaccaucaaaaugagcagggaucaggauaugcagccgaccugaagagcacacagaaugccauugacgggaucacuaacaagguaaacucuguuauugaaaagaugaacacacaauucacggcaguagguaaagaauucagccacuuggaaagaagaauagagaauuuaaauaaaaaaguagaugaugguuuucuagauauuuggacuuacaaugccgaacuauugguucuauuggaaaaugaaagaacuuuggauuaccacgacucaaaugugaaaaacuuguaugaaaaaguaagaagccaacuaaaaaacaaugccaaggaaauuggaaauggcugcuuugaauuuuaccacaaaugugaugacaugugcauggaaagcgucaaaaauggaacuuaugauuacccuaaauacucagaggaagcaaaacuaaacagagaagaaauagaugggguaaaguuggaaucaacaaggauuuaccaaauuuuggcuaucuauucaacggucgccaguucauugguacugguagucucccugggggcaaucaguuucuggaugugcucuaaugggucgcuacagugcagaauauguauuuaa

SEQ ID NO: 44378 - RNA, 1701 nt, Artificial Sequence; identical to SEQ ID NO: 37636
  hemagglutinin__InfluenzaA__EPI745532

SEQ ID NO: 44379 - RNA, 1701 nt, Artificial Sequence
  hemagglutinin__InfluenzaA__EPI278594
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagaacaauugagcucagugucaucauuugaaagguuugagauauuccccaagacaaguucauggcccgaucaugaaucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44380 - RNA, 1701 nt, Artificial Sequence
  hemagglutinin__InfluenzaA__AEE69009
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagauacauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44381 - RNA, 1701 nt, Artificial Sequence; identical to SEQ ID NO: 33455
  hemagglutinin__InfluenzaA__GQ280797

SEQ ID NO: 44382 - RNA, 1701 nt, Artificial Sequence; identical to SEQ ID NO: 33188
  hemagglutinin__InfluenzaA__EPI178457

SEQ ID NO: 44383 - RNA, 1701 nt, Artificial Sequence; identical to SEQ ID NO: 33188
  hemagglutinin__InfluenzaA__EPI176470

SEQ ID NO: 44384 - RNA, 1701 nt, Artificial Sequence
  hemagglutinin__InfluenzaA__EPI280341
augaaggcaauacuaguaguucugcuacauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaacgcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggaaucaagaagggagaaugaacuauuacuggacacuaguagagccgggagacaaaauaacauucgaagcaacuggaaaucuaguggcaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucuggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44385 - RNA, 1701 nt, Artificial Sequence
  hemagglutinin__InfluenzaA__EPI240319
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44386 - RNA, 1701 nt, Artificial Sequence; identical to SEQ ID NO: 33390
  hemagglutinin__InfluenzaA__EPI183134

SEQ ID NO: 44387 - RNA, 1701 nt, Artificial Sequence
  hemagglutinin__InfluenzaA__EPI368693
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcaucauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44388 - RNA, 1701 nt, Artificial Sequence
  hemagglutinin__InfluenzaA__EPI291788
augaaggcaauacuaguaguccugcuauauacauuuacaaccgcaaaugccgacacauuauguauagguuaucaugcgaacaauucaacugacaccguagacacaguacuagaaaagaauguaacaguaacacacucugucaaccuucuagaaaacaggcauaaugggaaacuauguaaacuaagagggguagcuccauugcauuuggguaaauguaacauugcuggcuggcuccugggaaauccagagugugaaucacucuccacagcaagcucaugguccuacauuguggaaacaucuaauucagacaaugggacguguuacccaggagauuucaucaauuaugaggagcuaagagagcaguugagcucagugucaucauuugaaagauuugagauauuccccaagacaaguucauggcccaaucaugacacgaacagaggugugacggcagcauguccucaugcugggacaaacagcuucuacagaaauuuaauauggcuggucaaaaaaggaaauucauacccaaagaucaacaaauccuacauuaacaauaaagagaaggaaguucucgugcuaugggccauucaccauccaucuaccagugccgaccaacaaagucucuaccaaaaugcagaugccuauguuuuuguggggucaucaagauacagcaggaaguucgagccagaaauagcaacaagacccaaggugagggaccaagcagggagaaugaacuauuacuggacacuaguagagccuggagacaagauaacauucgaagcaacuggaaaucuagugguaccgagauaugccuucgcauugaaaagaaauucuggaucugguauuaucauuucagauacaucaguccacgauugugauacgacuugucagacacccaauggugcuauaaacaccagccucccauuucaaaauauacauccagucacaauuggagaauguccaaaauauguaaaaaguacuaaacugagaauggccacaggauuaaggaauaucccgucuauucaaucuagaggccuguuuggggccauugcuggcuuuauugaagggggcuggacaggaaugauagauggaugguacgguuaucaccaucaaaaugagcagggaucaggauaugcagccgaccugaagagcacacagaaugccauugacgggaucacuaacaagguaaauucuguuauugaaaagaugaacacacaauucacagcaguagguaaagaguucagccacuuggaaagaagaauagagaauuuaaauaaaaagguugaugaugguuuucuagauauuuggacuuacaaugccgaacuguugguucuauuggaaaaugaaagaacuuuggauuaccacgacucaaaugugaaaaacuuauaugaaaaaguaagaagccaacuaaaaaacaaugccaaggaaauuggaaauggcugcuuugaauuuuaccacaaaugugaugacacgugcauggaaagcgucaaaaaugggacuuaugauuacccaaaauacucagaggaagcaaaacuaaacagagaggaaauagaugggguaaaguuggaaucaacaaggauuuaccaaauuuuggcgaucuauucaacggucgccaguucauugguacugguagucucccugggggcaaucaguuucuggaugugcucuaaugggucgcuacagugcagaauauguauuuaa

SEQ ID NO: 44389 - RNA, 1701 nt, Artificial Sequence
  hemagglutinin__InfluenzaA__EPI482788
augaaggcaauacuaguaguccugcuauauacauuuacaaccgcaaaugccgacacauuauguauagguuaucaugcgaacaauucaacugacaccguagacacaguacuagaaaagaauguaacaguaacacacucugucaaccuucuagaaaacaggcauaaugggaaacuauguaaacuaagagggguagcuccauugcauuuggguaaauguaacauugcuggcuggcuccugggaaauccagagugugaaucacucuccacagcaagcucaugguccuacauuguggaaacaucuaauucagacaaugggacguguuacccaggagauuucaucaauuaugaggagcuaagagagcaguugagcucagugucaucauuugaaagauuugagauauuccccaagacaaguucauggcccaaucaugacacgaacagaggugugacggcagcauguccucaugcugggacaaacagcuucuacagaaauuuaauauggcuggucaaaaaaggaaauucauacccaaagaucaacaaauccuacauuaacaauaaagagaaggaaguucucgugcuaugggccauucaccauccaucuaccagugccgaccaacaaaguaucuaccaaaaugcagaugccuauguuuuuguggggucaucaagauacagcaggaaguucgagccagaaauagcaacaagacccaaggugagggaccaagcagggagaaugaacuauuacuggacacuaguagagccuggagacaagauaacauucgaagcaacuggaaaucuagugguaccgagauaugccuucgcauugaaaagaaauucuggaucugguauuaucauuucagauacaucaguccacgauugugauacgacuugucagacacccaauggugcuauaaacaccagccucccauuucaaaauauacauccagucacaauuggagaauguccaaaauauguaaaaaguacuaaacugagaauggccacaggauuaaggaauaucccgucuauucaaucuagaggccuguuuggggccauugcuggcuuuauugaagggggcuggacaggaaugauagauggaugguacgguuaucaccaucaaaaugagcagggaucaggauaugcagccgaccugaagagcacacagaaugccauugacgggaucacuaacaagguaaauucuguuauugaaaagaugaacacacaauucacagcaguagguaaagaguucagccacuuggaaagaagaauagagaauuuaaauaaaaagguugaugaugguuuucuagauauuuggacuuacaaugccgaacuguugguucuauuggaaaaugaaagaacuuuggauuaccacgacucaaaugugaaaaacuuauaugaaaaaguaagaagccaacuaaaaaacaaugccaaggaaauuggaaauggcugcuuugaauuuuaccacaaaugugaugacacgugcauggaaagcgucaaaaaugggacuuaugauuacccaaaauacucagaggaagcaaaacuaaacagagaggaaauagaugggguaaaguuggaaucaacaaggauuuaccaaauuuuggcgaucuauucaacggucgccaguucauugguacugguagucucccugggggcaaucaguuucuggaugugcucuaaugggucgcuacagugcagaauauguauuuaa

SEQ ID NO: 44390 - RNA, 1701 nt, Artificial Sequence
  hemagglutinin__InfluenzaA__EPI178946/m1
augaaggcaauaauaguagucuugcuauauacauuugcaacugcagaugcugacacauuauguauaggcuaucaugcaaauaauucaacugacacuguugacacaguacuagaaaagaauguaacaguaacacacucuguuaaccuucuagaaaacaagcaugacgggaaacuauguaaacuaagagggguagccccauugcauuuggguaaauguaacauugcuggauggcucuugggaaacccagagugugaaucacuauucacagcaagcucaugguccuacauaguggaaacgccuaauucagacaaugggacauguuacccaggagauuucaucaauuaugaggagcuaagagagcauuugagcucugugucaucauuugaaagguuugagauauuccccaaggcuaauucauggcccaaccaugauacgaauaaggggguaacggcagcauguccuuaugcuggagcaaacagcuuuuacagaaauuuaauauggcuaguaaaaaaaggaaauucauacccaaagcucagcaaauccuacauuaacaauaagaagaaggaaguccuugugauauggggcauccaccauccaccuaccaguacugaccaacaaacucucuaccagaaugcagaugccuauguuuuugugggaucaucaaaauacagcaaaagauucaagccagaaauagcagcaagacccaaggugaggaaucaagcaggaagaaugaacuauuacuggacacuaauagaaccuggagacacaauaacauucgaagcaacuggaaaucuagugguaccaagauaugccuucgcaaugaaaagaggcucuggaucugguauuaucguuucagaugcaccaguccacgauuguaauacgacuugucaaacacccaaaggugcuauaaacaccagccuuccauuucagaauauacauccagucacaauuggagaauguccaaaauaugucaaaagcacaaaauugaggauggcuacaggacuaagaaauaucccgucuauucaaucaagaggccuauuuggggccauugcuggcuuccuugaagggggguggacaggaaugauagauggaugguacgguuaccaccaucaaaaugagcagggaucaggauaugcagccgaccaaaagagcacacagaaugccauugacgggaucacuaacaaaguaaauucuauuauugaaaagaugaacacacaauucacagcaguggguaaagaauucaaccaauuggaaaaaagaauagagaguuuaaacaauaaggucgaugauggguuccuagauauuuggacuuacaaugccgaaaugcugguucuauuggaaaaugaaagaacucuggauuaucacgauucaaaugugaagaaccuauaugaaaaaguaagaagccagcuaaaaaacaaugccaaagaaauuggaaauggcugcuuugaauuuuaccacaaaugcgauaacacgugcauggagagugucaaaaaugggacuuaugauuacccaaaauacucagaagaagcaaagcuaaauagagaggagauagaugggguaaagcuggaaucagcaaggauuuaccagauuuuggcgaucuauucaacugucgccagcucauugguacuguuagucucucugggggcagucaguuucuggaugugcuccaaugggucuuuacagugcagaauauguaucuaa

SEQ ID NO: 44391 - RNA, 1701 nt, Artificial Sequence
  hemagglutinin__InfluenzaA__EPI482791/m2
augaaggcaauaauaguagucuugcuauauacauuugcaacugcagaugcugacacauuauguauaggcuaucaugcaaauaauucaacugacacuguugacacaguacuagaaaagaauguaacaguaacacacucuguuaaccuucuagaaaacaagcaugacgggaaacuauguaaacuaagagggguagccccauugcauuuggguaaauguaacauugcuggauggcucuugggaaacccagagugugaaucacuauucacagcaagcucaugguccuacauaguggaaacgccuaauucagacaaugggacauguuacccaggagauuucaucaauuaugaggagcuaagagagcauuugagcucugugucaucauuugaaagguuugagauauuccccaaggcuaauucauggcccaaccaugagacgaauaaggggguaacggcagcauguccuuaugcuggagcaaacagcuuuuacagaaauuuaauauggcuaguaaaaaaaggaaauucauacccaaagcucagcaaauccuacauuaacaauaagaagaaggaaguccuugugauauggggcauccaccauccaccuaccaguacugaccaacaaacucucuaccagaaugcagaugccuauguuuuugugggaucaucaaaauacagcaaaagauucaagccagaaauagcagcaagacccaaggugaggaaucaagcaggaagaaugaacuauuacuggacacuaauagaaccuggagacacaauaacauucgaagcaacuggaaaucuagugguaccaagauaugccuucgcaaugaaaagaggcucuggaucugguauuaucguuucagaugcaccaguccacgauuguaauacgacuugucaaacacccaaaggugcuauaaacaccagccuuccauuucagaauauacauccagucacaauuggagaauguccaaaauaugucaaaagcacaaaauugaggauggcuacaggacuaagaaauaucccgucuauucaaucaagaggccuauuuggggccauugcuggcuuccuugaagggggguggacaggaaugauagauggaugguacgguuaccaccaucaaaaugagcagggaucaggauaugcagccgaccaaaagagcacacagaaugccauugacgggaucacuaacaaaguaaauucuauuauugaaaagaugaacacacaauucacagcaguggguaaagaauucaaccaauuggaaaaaagaauagagaguuuaaacaauaaggucgaugauggguuccuagauauuuggacuuacaaugccgaaaugcugguucuauuggaaaaugaaagaacucuggauuaucacgauucaaaugugaagaaccuauaugaaaaaguaagaagccagcuaaaaaacaaugccaaagaaauuggaaauggcugcuuugaauuuuaccacaaaugcgauaacacgugcauggagagugucaaaaaugggacuuaugauuacccaaaauacucagaagaagcaaagcuaaauagagaggagauagaugggguaaagcuggaaucagcaaggauuuaccagauuuuggcgaucuauucaacugucgccagcucauugguacuguuagucucucugggggcagucaguuucuggaugugcuccaaugggucuuuacagugcagaauauguaucuaa

SEQ ID NO: 44392 - RNA, 1701 nt, Artificial Sequence
  hemagglutinin__InfluenzaA__EPI291799
augaaggcaauacuaguaguccugcuauauacauuuacaaccgcaaaugccgacacauuauguauagguuaucaugcgaacaauucaacugacaccguagacacaguacuagaaaagaauguaacaguaacacacucugucaaccuucuagaaaacaggcauaaugggaaacuauguaaacuaagagggguagcuccauugcauuuggguaaauguaacauugcuggcuggcuccugggaaauccagagugugaaucacucuccacagcaagcucaugguccuacauuguggaaacaucuaauucagacaaugggacguguuacccaggagauuucaucaauuaugaggagcuaagagagcaguugagcucagugucaucauuugaaagauuugagauauuccccaagacaaguucauggcccaaucaugacacgaacagaggugugacggcagcauguccucaugcugggacaaacagcuucuacagaaauuuaauauggcugguaaaaaagggaaauucauacccaaagaucaacaaauccuacauuaacaauaaagagaaggaaguucucgugcuaugggccauucaccauccaucuaccagugccgaccaacaaagucucuaccaaaaugcagaugccuauguuuuuguggggucaucaagauacagcaggaaguucgagccagaaauagcaacaagacccaaggugagggaccaagcagggagaaugaacuauuacuggacacuaguagagccuggagacaagauaacauucgaagcaacuggaaaucuagugguaccgagauaugccuucgcauugaaaagaacuucuggaucugguauuaucauuucagauacaucaguccacgauugugauacgacuugucagacacccaauggugcuauaaacaccagccucccauuucaaaauauacauccagucacaauuggagaauguccaaaauauguaaaaaguacuaaacugagaauggccacaggauuaaggaauaucccgucuauucaaucuagaggccuguuuggggccauugcuggcuuuaucgaagggggcuggacaggaaugauagauggaugguacgguuaucaccaucaaaaugagcagggaucaggauaugcagccgaccugaagagcacacagaaugccauugacgggaucacuaacaagguaaauucuguuauugaaaagaugaacacacaauucacagcaguagguaaagaguucagccacuuggaaagaagaauagagaauuuaaauaaaaagguugaugaugguuuucuagauauuuggacuuacaaugccgaacuguugguucuauuggaaaaugaaagaacuuuggauuaccacgacucaaaugugaaaaacuuauaugaaaaaguaagaagccaacuaaaaaacaaugccaaggaaauuggaaauggcugcuuugaauuuuaccacaaaugugaugacacgugcauggaaagcgucaaaaauggaacuuaugauuacccuaaauacucagaggaagcaaaacuaaacagagaggaaauagaugggguaaaguuggaaucaacaaggauuuaccaaauuuuggcgaucuauucaacggucgccaguucauugguacugguagucucccugggggcaaucaguuucuggaugugcucuaaugggucgcuacagugcagaauauguauuuaa

SEQ ID NO: 44393 - RNA, 1701 nt, Artificial Sequence
  hemagglutinin__InfluenzaA__EPI482799
augaaggcaauacuaguaguccugcuauauacauuuacaaccgcaaaugccgacacauuauguauagguuaucaugcgaacaauucaacugacaccguagacacaguacuagaaaagaauguaacaguaacacacucugucaaccuucuagaaaacaggcauaaugggaaacuauguaaacuaagagggguagcuccauugcauuuggguaaauguaacauugcuggcuggcuccugggaaauccagagugugaaucacucuccacagcaagcucaugguccuacauuguggaaacaucuaauucagacaaugggacguguuacccaggagauuucaucaauuaugaggagcuaagagagcaguugagcucagugucaucauuugaaagauuugagauauuccccaagacaaguucauggcccaaucaugaaacgaacagaggugugacggcagcauguccucaugcugggacaaacagcuucuacagaaauuuaauauggcugguaaaaaagggaaauucauacccaaagaucaacaaauccuacauuaacaauaaagagaaggaaguucucgugcuaugggccauucaccauccaucuaccagugccgaccaacaaagucucuaccaaaaugcagaugccuauguuuuuguggggucaucaagauacagcaggaaguucgagccagaaauagcaacaagacccaaggugagggaccaagcagggagaaugaacuauuacuggacacuaguagagccuggagacaagauaacauucgaagcaacuggaaaucuagugguaccgagauaugccuucgcauugaaaagaacuucuggaucugguauuaucauuucagauacaucaguccacgauugugauacgacuugucagacacccaauggugcuauaaacaccagccucccauuucaaaauauacauccagucacaauuggagaauguccaaaauauguaaaaaguacuaaacugagaauggccacaggauuaaggaauaucccgucuauucaaucuagaggccuguuuggggccauugcuggcuuuaucgaagggggcuggacaggaaugauagauggaugguacgguuaucaccaucaaaaugagcagggaucaggauaugcagccgaccugaagagcacacagaaugccauugacgggaucacuaacaagguaaauucuguuauugaaaagaugaacacacaauucacagcaguagguaaagaguucagccacuuggaaagaagaauagagaauuuaaauaaaaagguugaugaugguuuucuagauauuuggacuuacaaugccgaacuguugguucuauuggaaaaugaaagaacuuuggauuaccacgacucaaaugugaaaaacuuauaugaaaaaguaagaagccaacuaaaaaacaaugccaaggaaauuggaaauggcugcuuugaauuuuaccacaaaugugaugacacgugcauggaaagcgucaaaaauggaacuuaugauuacccuaaauacucagaggaagcaaaacuaaacagagaggaaauagaugggguaaaguuggaaucaacaaggauuuaccaaauuuuggcgaucuauucaacggucgccaguucauugguacugguagucucccugggggcaaucaguuucuggaugugcucuaaugggucgcuacagugcagaauauguauuuaa

SEQ ID NO: 44394 - RNA, 1701 nt, Artificial Sequence
  hemagglutinin__InfluenzaA__EPI291807
augaaggcaauaauaguagucuugcuauauacauuugcaacugcagaugcugacacauuauguauaggcuaucaugcaaauaauucaacugacacuguugacacaguacuagaaaagaauguaacaguaacacacucuguuaaccuucuagaaaacaagcaugacgggaaacuauguaaacuaagagggguagccccauugcauuuggguaaauguaacauugcuggauggcucuugggaaacccagagugugaaucacuauucgcagcaagcucaugguccuacauaguggaaacgccuaauucagacaaugggacauguuacccaggagauuucaucaauuaugaggagcuaagagagcauuugagcucugugucaucauuugaaagguuugagauauuccccaaggcaaauucauggcccaaucaugauacgaauaagggggugacggcagcauguccuuaugcuggagcaaacagcuuuuacagaaauuuaauauggcuaguaaaaaaaggaaauucauacccaaagcucagcaaauccuacauuaacaauaagaagaaggaaguccucgugauauggggcauccaccauccaccuaccaguacugaccaacaaacucucuaccagaaugcagaugccuauguuuuugugggaucaucaaaauacagcaaaagauucaaaccagaaauagcagcaagacccaaggugagggaucaagcaggaaggauggauuauuacuggacacuaauagaaccuggagacacaauaacauucgaagcaacuggaaaucuagugguaccaagauaugccuucgcaaugaaaagaggcucuggaucugguauuaucguuucagaugcaccaguccacgacuguaauacgacuugucaaacacccaaaggugcuauaaacaccagccuuccauuucagaauauacauccagucacaaucggggaauguccaaaauaugucaaaagcacaaaauugaggauggcuacaggauuaagaaauaucccgucuauucaaucaagaggccuauuuggggccauugcuggauucauugaagggggguggacaggaaugauagauggaugguacgguuaccaccaucaaaaugagcaggggucaggauaugcagccgaccaaaagagcacacagaaugccauugacgggaucacuaacaaaguaaauucuauuauugaaaagaugaacacacaauucacagcaguggguaaagaauucagccaauuggaaaaaagaauagagaguuuaaacaauaagguugaugauggguuccuagauauuuggacuuacaaugccgaacugcugguucuauuggaaaaugaaagaacucuggauuaucacgauucaaaugugaagaaccuauaugaaaaaguaagaagccagcuaaaaaacaaugccaaagaaauuggaaauggcugcuuugaauuuuaccacaaaugcgauaacacgugcauggagagugucaaaaaugggacuuaugauuacccaaaauacucagaagaagcaaagcuaaauagagaggagauagaugggguaaagcuggaaucagcaaggauuuaccagauuuuggcgaucuauucaacugucgccagcucauugguacuguuagucucucugggggcagucagcuucuggaugugcuccaaugggucuuuacagugcagaauauguaucuaa

SEQ ID NO: 44395 - RNA, 1701 nt, Artificial Sequence
  hemagglutinin__InfluenzaA__EPI638970
augaaggcaauacuaguaguccugcuauauacauuuacaaccgcaaaugccgacacauuauguauagguuaucaugcaaacaauucaacugacaccguagacacaguacuagaaaagaauguaacaguaacacacucugucaaccuucuagaaaacaggcauaaugggaaacuaugcaaacuaagagggguagcuccauugcacuuggguaaauguaacauugcuggauggauucugggaaauccagagugugaaucacucuccacagcaagcucaugguccuacauuguggaaacaucuaauucagaaaaugggacguguuacccaggagauuucauaaauuaugaggagcuaagagagcaguugagcucagugucaucauuugaaagauuugagauauuccccaagacaaguucauggcccaaucaugacacgaacaaaggugugacggcagcauguccucauucugggacaaacagcuucuacagaaauuuaguauggcuaguacaaaagggaaauucauacccaaaaaucaacaaauccuacauuaacaauaaagagaaugaaguucucgugcuaugggccauucaccauccaucuaccagugccgaccaacagagucucuacaaaaaugcagaugccuauguguuuguggggucaucaagauacagcaggaaguucgagccagaaauagcaacaagaccuaaagugagagaccaagcagggagaaugaauuauuacuggacacuaguagagccuggagacaagauaacauucgaagcaacuggaaaucuaguggcaccgagauaugccuucacauugaaaagaaauucuggaucugguauuaucauuucagauacaucaguccacgauugugauacaacuugucagacacccaauggugcuauaaacaccagccucccauuucaaaauauacauccagucacaauuggagaauguccaaaauauguaaaaaguacuaaacugagaauggccacagguuuaaggaauaucccgucuauucaaucuagaggccuguuuggugccauugcuggcuuuauugaaggggguuggacaggaaugauagauggaugguacgguuaucaccaucaaaaugagcagggaucaggauaugcagccgaccugaagagcacacaaaaugccauugaugggaucacuaacaaggugaacucuguuauugaaaagaugaacacccaauucacggcaguagguaaagaguucagccacuuggaaagaagaauagagaauuuaaauaaaaagguugaugaugguuuucuagauauuuggacuuacaaugccgaacuguugguucuauuggaaaaugaacgaacuuuggauuaccacgacucaaaugugaaaaacuuauaugaaaaaguaagaagccaacuaaaaaacaaugccaaggaaauugggaauggcugcuuugaauuuuaccacaaaugugaugacaugugcauggaaagcgucaaaaauggaacuuaugauuacccuaaauacucagaggaagcaaaacuaaacagagaggaaauagaugggguaaaguuggaaucaacaaagauuuaccaaauuuuggcgaucuauucaacggucgccaguucauugguacugguagucucccugggggcaaucaguuucuggaugugcucuaaugggucgcuacagugcagaauauguauuuaa

SEQ ID NO: 44396 - RNA, 1701 nt, Artificial Sequence
  hemagglutinin__InfluenzaA__ABI19015
augaaggcaauaauaguaguuuugcuauauacauuugcaacugcagaugcugacacauuauguauaggcuaucaugcaaauaauucaacugacacuguugacacaguacuagaaaagaauguaacaguaacacacucuguuaaccuucuagaaaacaagcaugacgggaaacuauguaaacuaagagggauagccccauugcauuuggguaaauguaacauugcuggauggaucuugggaaacccagagugugaaucacuauucacaacaagcucauggucauacauaguggaaacgccuaauucagacaaugggacauguuacccaggagauuucaucaauuaugaggagcuaagagagcauuugagcucugugucaucauuugaaagguuugagauauuccccaaggcaaauucauggcccuaucaugauacgaauaaaggggugacggcagcauguccuuaugcuggagcaaacagcuuuuacagaaauuuaauauggcuaguaaaaaaaggaaauucauacccaaagcucaguaaauccuacauuaacaauaagaagaaagaaguccucgugauauggggcauccaccauccaccuaccaguacugaccaacaaacucucuaccagaaugcagaugcuuauguuuuugugggaucaucaaaauacagcaagagauucaagccagaaauagcagcaagacccaaggugagggaucaagcaggaaggauggacuauuacuggacacuaauagaaccuggagacacaauaacauucgaagcaacuggaaaucuagugguaccaagauaugccuucacaaugaaaagaggcucuggaucugguauuaucguuucagacgcaccaguccacgauuguaauacgacuugucaaacacccaaaggugcuauaaacaccagccuuccauuucagaauauacauccagucacaauuggagaauguccaaaauaugucaaaagcacaaaauugaggauggcuacaggauuaagaaauaucccgucuauucaaucaagaggccuauuuggggccauugcuggcuucauugaagggggguggacaggaaugauagauggaugguacgguuaucaccaucaaaaugagcagggaucaggauaugcagccgaccaaaagagcacacagaaugccauugacgggaucacuaacaaaguaaauucuauuauugaaaagaugaacacacaauucacagcaguggguaaagaauucagccaauuggaaaaaagaauagagaguuuaaacaauaagguugacgaugguuuucuagauauuuggacuuacaaugccgaacugcugguucuauuggaaaaugaaagaacucuggauuaucacgauucaaaugugaagaaccuauaugaaaaaguaagaagccagcuaaaaaacaaugccaaagaaauuggaaauggcugcuuugaauuuuaccacaaaugugaugacacgugcauggagagugucaaaaaugggacuuaugauuacccaaaauacucagaagaagcaaagcuaaauagacaggagauagaugggguaaagcuggaaucagcaaggauuuaccagauuuuggcgaucuauucaacugucgccagcucauugguacuguuagucucucuaggggcagucaguuucuggaugugcuccaaugggucuuuacagugcagaauauguaucuag

SEQ ID NO: 44397 - RNA, 1701 nt, Artificial Sequence
  hemagglutinin__InfluenzaA__EPI687790
augaaggcaauacuaguaguucugcuauauacauuuacaaccgcaaaugcagacacauuauguauagguuaucaugcaaacaauucaacagacacuguagacacaguacuagaaaagaauguaacaguaacacacucuguuaaccuucuggaagacaagcauaacggaaaacuaugcaaacuaggagggguagccccauugcauuuggguaaauguaacauugcuggcuggauccugggaaauccagagugugaaucacucuccacagcaaguucaugguccuacauuguggaaacaucuaauucagacaauggaacguguuacccaggagauuucaucaauuaugaggagcuaagagagcaauugagcucagugucaucauuugaaagguuugagauauuccccaagacaaguucauggcccaaucaugauucgaacaaagguguaacggcagcauguccucacgcuggagcaaaaagcuucuacaaaaacuugauauggcuaguuaaaaaaggaaauucauacccaaagcucaaccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaacaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaaucuaaauaaaaaaguugaugaugguuuccuggacauuuggacuuacaaugccgaacuguugguucuauuggaaaaugaaagaacuuuggacuaucacgauucaaaugugaagaacuuguaugaaaaaguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 44398 - RNA, 1701 nt, Artificial Sequence
  hemagglutinin__InfluenzaA__EPI841265
augaaggcaauacuaguaguucugcuauauacauuuacaaccgcaaaugcagacacauuauguauagguuaucaugcaaacaauucaacagacacuguagacacaguacuagaaaagaauguaacaguaacacacucuguuaaccuucuggaagacaagcauaacggaaaacuaugcaaacuaggagggguagccccauugcauuuggguaaauguaacauugcuggcuggauccugggaaauccagagugugaaucacucuccacagcaaguucaugguccuacauuguggaaacaucuaauucagacaauggaacguguuacccaggagauuucaucaauuaugaggagcuaagagagcaauugagcucagugucaucauuugaaagguuugagauauuccccaagacaaguucauggcccaaucaugauucgaacaaagguguaacggcagcauguccucacgcuggagcaaaaagcuucuacaaaaacuugauauggcuaguuaaaaaaggaaauucauacccaaagcucaaccaauccuacauuaaugauaaagggaaagaaguccucgugcuguggggcauucaccauccaucuacuacugcugaccaacaaaguaucuaucagaaugcagaugcauauguuuuuguggggacaucaagauacagcaagaaguucaagccggaaauagcaacaagacccaaagugagggaucaagaagggagaauuaacuauuacuggacacuaguagagccgggagacaaaauaacauucgaagcaacuggaaaucuagugguaccgagauaugcauucacaauggaaagaaaugcuggaucugguauuaucauuucgaauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaaucuaaauaaaaaaguugaugaugguuuccuggacauuuggacuuacaaugccgaacuguugguucuauuggaaaaugaaagaacuuuggacuaucacgauucaaaugugaagaacuuguaugaaaaaguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 44399 - RNA, 1701 nt, Artificial Sequence
  hemagglutinin__InfluenzaA__EPI291846
augaaggcaauaauaguagucuugcuauauacauuugcaacugcagaugcugacacauuauguauaggcuaucaugcaaauaauucaacugacacuguugacacgguacuagaaaagaauguaacaguaacacacucuguuaaccuucuagaaaacaagcaugacggaaaacuauguaaccuaaaagggguagccccauugcauuuggguaaauguaacauugcuggauggcucuugggaaacccagagugugaaucacuauucacagcaagcucaugguccuacauaguggaaacgccuaauucagacaaugggacauguuacccaggagauuucaucaauuaugaggagcuaagagagcauuugagcucugugucaucauuugaaagguuugagauauuccccaagguuaauucauggcccaaccaugauacaaauaagggggugacggcagcaugcccuuaugcuggagcaaacagcuuuuacagaaauuuaauauggcuaguaaaaaaaggaaauucauacccaaagcucagcaaaucuuacauuaacaacaagaagaaggaaguccucgugauauggggcauucaccauccacccaccagcacugaucaacaaacucucuaccagaaugcagaugccuauguuuuugugggaucaucaaaauacagcaaaagauucgagccagaaauagcagcaagacccaaggugaggaaucaagcaggaagaaugaacuauuacuggacacuaauagaaccuggagacacaauaacauucgaagcaacuggaaaucuagugguaccaagauaugccuucgcaaugagaagaggcucuggaucugguauuauuguuucagaugcaccaguccacgauuguaauacgacuugucaaacacccaaaggugcuauaaacaccagccuuccauuucagaauauacauccagucacaauuggagaauguccaaaauaugucaaaagcacaaaauugaggauggcuacaggauuaagaaauaucccgucuauucaaucaagaggccuauuuggggccauugcuggcuuccuugaagggggguggacaggaaugauagauggaugguacgguuaccaccaucaaaaugagcagggaucaggauaugcagccgaccaaaagagcacacagaacgccauugacgggaucacuaacaaaguaaauucuauuauugaaaagaugaacacacaauucacagcaguggguaaagaauucagccaauuggaaaaaagaauagagaguuuaaacaauaaggucgaugauggguuccuagacauuuggacuuacaaugccgaaaugcugguucuauuggaaaaugaaagaacucuggauuaucacgauucaaaugugaagaaccuauaugaaaaaguaagaagccagcuaaaaaacaaugccaaagaaauuggaaauggcugcuuugaauuuuaccacaaaugcgauaacacgugcauggagagugucagaaaugggacuuaugauuacccaaaauacucagaagaagcaaagcuaaauagagaggagauagaugggguaaagcuggaaucagcaaggauuuaccagauuuuggcgaucuauucaacugucgccagcucauugguacuguuagucucucugggggcagucaguuucuggaugugcuccaaugggucuuuacagugcaggauauguaucuaa

SEQ ID NO: 44400 - RNA, 1695 nt, Artificial Sequence
  hemagglutinin__InfluenzaA__EPI558121
augaaggcaauacuaguaguccugcuauauacauuuacaaccgcaaaugccgacacauuauguauagguuaucaugcaaacaauucaacugacacuguagacacaguacuagaaaagaauguaacaguaacacacucugucaaccuucuagaaaacaggcauaaugggaaacuauguaaacuaagagggguagcuccauugcauuuggguaaauguaacauugcuggcuggcuucugggaaauccagagugugaaucacucuccacagcaagcucaugguccuacauuguggaaacaucuaauucagacaaugggacguguuacccaggagauuucaucaauuaugaagagcuaagagagcaguugagcucagugucaucauuugaaagauucgagauauucccccagacaaguucauggcccaaucaugacacgaacagaggugugacggcagcauguccucaugcugggacgaacagcuucuacagaaauuuaguauggcuaguaaaaaaggggaauucauacucaaagaucaacaaauccuacauuaacaauaaagagaaggaaguucucgugcuaugggccauucaccauccaucuaccagugccgaccaacaaagucucuaccaaaaugcagaugccuauguguuuguggggucaucaagauacagcaggaaguucgagccagaaauagcaacaagaccuaaggugagagaccaagcagggagaaugaacuauuacuggacacuaguagagccuggagacaagauaacauucgaagcuacuggaaaucuaguggcaccgagauaugccuucgcauugaaaagaaauucuggauccgguauuaucauuucagauacaucaguccacgauugugauacgacuugucagacacccaauggugcuauaaacaccagccucccauuucaaaauauacauccagucacaauuggagaauguccaaaauauguaaaaaguacuaaacugagaauggccacagguuuaaggaauaucccgucuauccaaucuagaggccuguuuggugccauugcuggcuuuaucgaaggggguuggacaggaaugauagauggaugguacgguuaucaccaucaaaaugagcagggaucaggauaugcagccgaccugaagagcacacagaaugccauugacgggaucacuaacaagguaaacucuguuauugaaaagaugaacacacaauucacggcaguagguaaagaguucagccacuuggaaagaagaauagagaauuuaaauaaaaaaguagaugaugguuuucuagauauuuggacuuacaaugccgaacuguugguucuauuggaaaaugaaagaacuuuggauuaccacgacucaaaugugaaaaacuuauaugaaaaaguaagaagccaacuaaaaaacaaugccaaagaaauugguaauggcuguuuugaauuuuaccacaaaugugaugacaugugcauggaaagcgucaaaaauggaacuuaugauuacccuaaauacucagaggaagcaaaacuaaacagagaggaaauagaugggguaaaguuggaaucaacaaggauuuaccaaauuuuggcgaucuauucaacggucgccaguucauugguacugguagucucccugggggcaaucaguuucuggaugugcucuaaugggucgcuacagugcagaauauaa

SEQ ID NO: 44401 - RNA, 1701 nt, Artificial Sequence
  hemagglutinin__InfluenzaA__EPI564139
augaagacuaucauugccuugagcuacauucuaugucugguuuucgcucaaaaaaucccuggaaaugacaauagcacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44402 - RNA, 1701 nt, Artificial Sequence
  hemagglutinin__InfluenzaA__EPI786706
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaucuucuggaagacaagcauaacggaaaacuaugcaaacuaagagggguagccccauugcauuuggguaaauguaacauugcuggcuggauccugggaaauccagagugugaaucacucuccacagcaaguucaugguccuacauuguggaaacaucuaauucagacaauggaacguguuacccaggagauuucaucaauuaugaggagcuaagagagcaauugaguucagugucaucauuugaaagguuugaaauauuccccaagacaaguucauggcccaaucaugacucgaacaaagguguaacggcagcauguccucacgcuggagcaaaaagcuucuacaaaaacuugauauggcuaguuaaaaaaggaaauucauacccaaagcucaaccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaacaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauugggaaauguccaaaguauguaaaaagcacaaaauugagacuggccacaggauuaaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagaucacuaacaaaguaaauucuguuauugaaaagaugaauacacaguucacagcaguggguaaagaguucaaccaccuggaaaaaagaauagagaaucuaaauaaaaaaguugaugaugguuuccuagacauuuggacuuacaaugccgaacuguugguucuauuggaaaaugaaagaacuuuggacuaucacgauucaaaugugaagaacuuguaugaaaaaguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggaucuaccagauuuuggcgaucuauucaacugucgccaguucauugguacugguagucucccugggggcaaucagcuucuggaugugcucuaaugggucucuacaguguagaauauguauuuaa

SEQ ID NO: 44403 - RNA, 1701 nt, Artificial Sequence
  hemagglutinin__InfluenzaA__EPI395313
augaaggcaauacuaauaguccugcuauauacauuuacaaccgcaaaugccgacacauuauguauagguuaucaugcaaacaauucaacugacaccguagacacaguacuagaaaagaauguaacaguaacacacucugucaaccuucuagaaaacaggcauaaugggaaacuauguaaacuaagagggguagcuccauugcauuuggguaaauguaacauugcuggcuggcuucugggaaauccagagugugaaucacucuccacagcaagcucaugguccuacauuguggaaacaucuaauucagacaaugggacguguuacccaggagauuucaucaauuaugaggagcuaagagagcaguugagcucagugucaucauuugaaagauuugagauauuccccaagacaaguucauggcccaaucaugacacgaacagaggugugacggcagcauguccucaugcugggacaaaaagcuucuacaaaaauuuaauauggauagcaaaaaagggaaauucauacccaaagaucaacaaauccuacauuaacaauaaagagaaggaaguucucgugcuaugggccauucaccauccaucuaccagugcugaccaacaaagucucuaccaaaaugcagaugccuauguguuuguggggucaucaagauacagcaggaaguucgagccagaaauagcaacaagacccaaggugagagaccaagcagggagaaugaacuauuacuggacacuaguagagccuggagacaagauaacauucgaagcaacuggaaaucuaguggcaccgagauaugccuucgcauugaaaagaaauucuggaucugguauuaucauuucagauacaucaguccacgauugugauacgacuugucagacacccaauggugcuauaaacaccagccucccauuucaaaauauacauccagucacaauuggagaauguccaaaauauguaaaaaguacuaaacugagaauggccacaggauuaaggaauaucccgucuauucaaucuagaggccuguuuggugccauugcuggcuuuaucgaagggggcuggacaggaaugauagauggaugguacgguuaucaccaucaaaaugagcagggaucaggauaugcagccgaccugaagagcacacagaaugccauugacgggaucacuaacaagguaaacucuguuauugaaaagaugaacacacaauucacggcaguagguaaagaguucagccacuuggaaagaagaauagagaauuuaaauaaaaagguugaugaugguuuucuagauauuuggacuuacaaugccgaacuguugguucuauuggaaaaugaaagaacuuuggauuaccacgacucaaaugugaaaaacuuauaugaaaaaguaagaagccaacuaaaaaacaaugccaaggaaauuggaaauggcugcuuugaauuuuaccacaaaugugaugacaugugcauggaaagugucaaaaauggaacuuaugauuacccuaaauacucagaggaagcaaaacuaaacagagagguaauagaugggguaaaguuggaaucaacaaggauuuaccaaauuuuggcgaucuaugcaacggucgccaguucauugguacugguagucucccugggggcaaucaguuuuuggaugugcucuaaugggucgcuacagugcagaauauguauuuaa

SEQ ID NO: 44404 - RNA, 1701 nt, Artificial Sequence
  hemagglutinin__InfluenzaA__EPI291696
augaaggcaauacuauuagucuugcuauauacauucacagccgcaaaugcagacacauuauguauagguuaucaugcaaauaauucaacugacacuguugauacgguacuagaaaagaauguaacaguuacacacucuguuaaucuucuagaaaacagacauaacggaaagcuauguaaacuaagggggguacccccauugcauuuggguaaauguaacauugcuggauggcuccugggaaacccagaaugugaauuacuauucacagcaagcucauggucuuacauuguggaaacaucuaacucagacaaugggacauguuacccaggagauuucaucaauuaugaagagcuaagagagcaguugagcucagugucaucauuugaaagguuugagauauuccccaaggcaaguucauggcccgaucaugaaacgaacagaggugugacggcagcauguccuuaugcuggagcaaacagcuucuacagaaauuuaauauggcugguaaaaaaaggaaauucauacccaaaacucagcaaauccuauguuaacaauaaggagaaggaaguccucgugcuauggggcauucaccauccaccuaccaguacugaccaacaaagucucuaccagaaugcagaugccuauguuuuuguggggucaucaaaguacaacaagaaauucaagccagagauggcggcaagacccaaggugagaggucaagcagggagaaugaacuauuacuggacacuaguugcgccuggagacacaauaacauucgaagcaacuggaaaucuaguggugccaagauaugccuucgcaaugaaaagagguucuggaucugguauuaucauuucagauacaccaguccacgauuguaauacgacuugucaaacacccaaaggugcuauaaacaccagccucccauuucagaauauacauccagucacaauuggagaauguccaaaauaugucaaaaguacaaaauugagaauggcuacaggauuaaggaauaucccgucuauucaaucuagaggucuguuuggagccauugcuggcuuuauugaggggggauggacaggaaugauagauggaugguacgguuaucaccaucaaaaugagcagggaucaggauaugcagcugaccgaaagagcacacagaaugccauugacgggaucacuaacaaaguaaacucuguuauugaaaagaugaacacacaauucacagcaguggguaaagaauucaaccaccuggaaaaaagaauagagaauuuaaacaaaaagguugaugaugguuuucuggauguuuggacuuacaaugccgaacuguugguucuauuggaaaaugaaagaacuuuggauuaccaugacucaaaugugaagaaccuauaugagaaaguaagaagccagcuaaaaaacaaugccaaggaaauuggaaauggcugcuuugaauuuuaccacaaaugugaugacacgugcauggagagcgucaaaaaugggacuuaugauuacccaaaauacucagaagaaucaaaacuaaacagagaggaaauagaugggguaaagcuggaaucaacaaggauuuaccagauuuuggcgaucuauucaacugucgccaguucauugguacugucagucucccugggggcaaucaguuucuggaugugcuccaaugggucuuuacagugcagaauauguauuuaa

SEQ ID NO: 44405 - RNA, 1701 nt, Artificial Sequence; identical to SEQ ID NO: 40335
  hemagglutinin__InfluenzaA__ACU80014

SEQ ID NO: 44406 - RNA, 1701 nt, Artificial Sequence; identical to SEQ ID NO: 33173
  hemagglutinin__InfluenzaA__EPI177400

SEQ ID NO: 44407 - RNA, 1701 nt, Artificial Sequence
  hemagglutinin__InfluenzaA__ACT36512
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucgucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgaaauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaacuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44408 - RNA, 1704 nt, Artificial Sequence
  hemagglutinin__InfluenzaA__AJE30344
auggagaaaauagugcuucuucuugcagugauuagccuuguuaaaagugaucagauuugcauugguuaccaugcaaacaacucaacaaagcagguugacacgauaauggagaaaaacgucacuguuacacaugcccaagacauacuggaaaagacacacaacgggaagcucugcgaucuuaauggagugaagccccugauucuaaaggauuguagcguagcuggguggcuccuuggaaauccaaugugcgacgaguucaucaggguaccggaauggucuuacaucguggagagggcuaacccagccaacgaccucuguuacccagggacccucaaugacuaugaggaacugaaacaccuauugagcagaauaaaucauuuugagaaaaaucugaucauccccaggaguucuuggcccaaucaugaaacaucauuaggggugagcgcagcauguccauaccagggagcauccucauuuuucagaaaugugguauggcucaucaaaaagaacgaugcauacccgacaauaaagauaagcuacaauaauaccaaucgggaagaucuuuugauacugugggggauucaucauuccaacaaugcagcagagcagacaaaucucuauaaaaacccagacacuuauguuuccguugggacaucaacauuaaaccagagauuggugccaaaaauagcuacuagaucccaaguaaacgggcagaguggaagaauggauuucuucuggacaauuuuaaaaccgaaugaugcaauccacuuugagaguaauggaaauuucauugcuccagaauaugcauacaaaauugucaagaaaggggacucaacaauuaugaaaagugaaauggaguauggccacugcaacaccaaaugucaaacuccaauaggggcgauaaacucuagcaugccauuccacaauauacacccucucaccaucggggaaugccccaaauacgugaagucaaacaaauuaguccuugcgacugggcucagaaauaguccucuaagagaaagaagaagaaaaagaggacuauuuggagcuauagcaggguuuauagagggaggauggcagggaaugguagacgguugguauggguaucaucauagcaaugagcaggggaguggguacgcugcagacaaagaaucaacccaaaaggcaauagauggaguuaccaauaaggucaacucaaucauugacaaaaugaacacucaauuugaggccguuggaagggaauuuaauaacuuagaaaggagaauagagaauuuaaacaagaaaauggaagacggauuccuagaugucuggacuuauaaugcugaacuuuuaguucucauggaaaaugagagaacucuagauuuccaugacucaaaugucaagaaccuuuacgacaaaguccgacuacagcuuagggauaaugcaaaggagcuggguaaugguuguuucgaguucuaucacaaaugugauaacgaauguauggagagcguaagaaaugggacguaugacuacccuaaguauucagaagaagcaauauuaaaaagagaagaaauaagcggagugaaauuagaaucaauaggaacuuaccagauacugucaauuuauucaacaguggcgaguucccuagcacuggcaaucauaguggcuggucuaucuuuauggaugugcucuaaugggucguuacaaugcagaauuugcaucuaa

SEQ ID NO: 44409 - RNA, 1701 nt, Artificial Sequence; identical to SEQ ID NO: 44388
  hemagglutinin__InfluenzaA__EPI178948

SEQ ID NO: 44410 - RNA, 1701 nt, Artificial Sequence; identical to SEQ ID NO: 44388
  hemagglutinin__InfluenzaA__EPI178949

SEQ ID NO: 44411 - RNA, 1701 nt, Artificial Sequence
  hemagglutinin__InfluenzaA__EPI590132
augaaggcaauacuaauaguccugcuauauacauuuacaaccgcaaaugccgacaaaauauguauagguuaucaugcgaacaauucaacugacaccguagacacaguacuagaaaagaauguaacaguaacacacucugucaaccuucuagaaaacaagcauaauggaaaacuauguaaacuaagagggguagcuccauugcauuuggguaaauguaacauugcuggcuggcuccugggaaauccagagugugaaucacucgccacagcaagcucaugguccuacauuguugaaacuucuaguucgaacaaugggacguguuacccaggagauuucaucaauuaugaagagcuaagagaacaguuaagcucagugucaucauuugaaaaauuugagauauuccccaagacgaguucauggcccaaucaugaaacaaacaaagguguaacggcagcauguccacaugcugggacaaacagcuucuacaaaaauuuaauauggcuggucaaaaaagagaauucauacccaaagaucaacauauccuacacuaacaauagagggaaggaaguucucguguuaugggccauucaccauccaccuaccagcaccgaucaacaaagucucuaccaaaaugcaaauuccuauguuuuuguggggucaucaagauacagcaggaaguucgagccagaaauagcaacaagacccaaggugaggggccaagcagggagaaugaacuauuacuggacauuaguagagccuggagacaagauaacauucgaagcaacuggaaauuuggugguaccgagauaugccuucgcauugaaaagaaauucuggaucugguauuaucauuucagagacaccaguccacgauugugauacgacuugucagacacccaauggugcuauuaacaccagccucccauuucagaauauacauccagucacaauuggggaaugcccaaaauauguaaaaaguacuaaauugagaauggccacaggauugaggaacaucccguccauucaaucuagaggccuguuuggggccauugccggcuuuauugaagggggcuggacaggaaugauagaugggugguacgguuaucaccaucaaaaugagcaaggaucaggauaugcagccgaccugaagagcacacagaaugccauugacgggaucacuaauaagguaaauucuguuauugaaaagaugaauacacaauucacagcaguagguaaagaguucagccacuuggaaagaagaauagagaauuuaaauaaaaagguugaugauggguuuauagauauuuggacuuacaaugccgaacuguugguucuguuggaaaaugaaagaacuuuggauuaccacgacucaaaugugaaaaccuuauaugaaaaaguaagaagccaacuaaaaaacaaugccaaggaaauuggaaacggcugcuuugaauuuuaccacaaaugugaugacacgugcauggagagcgucaaaaauggaacuuaugauuacccaaaauacucagaggaagcaaaacuaaacagagaggaaauagaugggauaaaguuggaaucaacaaggauuuaccaaauuuuggcgaucuauucaacugucgccaguucauugguacugguagucucccugggggcaaucaguuucuggaugugcucuaaugggucgcuacagugcagaguauguauuuaa

SEQ ID NO: 44412 - RNA, 1701 nt, Artificial Sequence; identical to SEQ ID NO: 32240
  hemagglutinin__InfluenzaA__ABU80400

SEQ ID NO: 44413 - RNA, 1698 nt, Artificial Sequence
  hemagglutinin__InfluenzaA__ABO21709
augaaggcaaaccuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaaggagggcucauacccaaagcugaaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacaauccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 44414 - RNA, 1701 nt, Artificial Sequence
  hemagglutinin__InfluenzaA__CAZ65588
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagaaccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44415 - RNA, 1701 nt, Artificial Sequence
  hemagglutinin__InfluenzaA__EPI697744
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaucuucuggaagacaagcauaacggaaaacuaugcaaacuaagagggguagccccauugcauuuggguaaauguaacauugcuggcuggauccugggaaauccagagugugaaucacucuccacagcaaguucaugguccuacauuguggaaacaucuaauucagacaauggaacguguuacccaggagauuucaucaauuaugaggagcuaagagagcaauugagcucagugucaucauuugaaagguuugaaauauuccccaagacaaguucauggcccaaucaugacucgaacaaagguguaacggcagcauguccucacgcuggagcaaaaagcuucuacaaaaacuugauauggcuaguuaaaaaaggaaauucauacccaaagcucaaccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaacaagacccaaagugagggaucaagaagggagaaugaacuauuacuggacacuaguagagccgggagacaaaauaacauucgaagcaacuggaaaucuagugguaccgagguaugcauucacaauggaaagaaaugcuggaucugguauuaucauuucagauacaccaguccacgauugcaauacaacuugucagacacccgagggugcuauaaacaccagccucccauuucagaauauacauccgaucacaauugggaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaaucuaaauaaaaaaguugaugaugguuuccuggacauuuggacuuacaaugccgaacuguugguucuauuggaaaaugaaagaacuuuggacuaucacgauucaaaugugaagaacuuguaugaaaaaguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggaucuaccagauuuuggcgaucuauucaacugucgccaguucauugguacugguagucucccugggggcaaucagcuucuggaugugcucuaaugggucucuacaguguagaauauguauuuaa

SEQ ID NO: 44416 - RNA, 1701 nt, Artificial Sequence
  hemagglutinin__InfluenzaA__EPI768525
augaaggcaauacuaguaguucuguuauauacauuuacaaccgcaaaugcagacacauuauguauagguuaucaugcgaacaauucaacagacacuguagacacaguacuagaaaagaauguaacaguaacacacucuguuaaucuucuggaagacaagcauaacggaaaacuaugcaaacuaagagggguagccccauugcauuuggguaaauguaacauugcuggcuggauccugggaaauccagagugugaaucacucuccacagcaaguucaugguccuacauuguggaaacaucuaauucagacaauggaacguguuacccaggagauuucaucaauuaugaggagcuaagagagcaauugagcucagugucaucauuugaaagguuugaaauauuccccaagacaaguucauggcccaaucaugacucgaacaaagguguaacggcagcauguccucacgcuggagcaaaaagcuucuacaaaaacuugauauggcuaguuaaaaaaggaaauucauacccaaagcucaaccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaacaagacccaaagugagggaucgagaagggagaaugaacuauuacuggacacuaguagagccgggagacaaaauaacauucgaagcaacuggaaaucuagugguaccgagguaugcauucacaauggaaagaaaugcuggaucugguauuaucauuucagauacaccaguccacgauugcaauacaacuugucagacacccgagggugcuauaaacaccagccucccauuucagaauauacauccgaucacaauugggaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaaucuaaauaaaaaaguugaugaugguuuccuggacauuuggacuuacaaugccgaacuguugguucuauuggaaaaugaaagaacuuuggacuaucacgauucaaaugugaagaacuuguaugaaaaaguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggaucuaccagauuuuggcgaucuauucaacugucgccaguucauugguacugguagucucccugggggcaaucagcuucuggaugugcucuaaugggucucuacaguguagaauauguauuuaa

SEQ ID NO: 44417 - RNA, 1701 nt, Artificial Sequence
  hemagglutinin__InfluenzaA__EPI726930
augaaggcaauacuaguaguucugcuauauacauuuacaacugcaaaugcagacacauuauguauagguuaucaugcgaacaauucaacagacacuguagacacaguacuagaaaagaauguaacaguaacacacucuguuaaucuucuggaagacaagcauaacggaaaacuaugcaaacuaagagggguagccccauugcauuuggguaaauguaacauugcuggcuggauccugggaaauccagagugugaaucacucuccacagcaaguucaugguccuacauuguggaaacaucuaauucagacaauggaacguguuacccaggagauuucaucaauuaugaggagcuaagagagcaauugagcucagugucaucauuugaaagguuugaaauauuccccaaggcaaguucauggcccaaucaugacucgaacaaagguguaacggcagcauguccucacgcuggagcaaaaagcuucuacaaaaacuugauauggcuaguuaaaaaaggaaauucauacccaaagcucaaccaauccuacauuaaugauaaagggaaagaaguccucgugcuguggggcauucaccauccaucuacuacugcugaccaacaaagucucuaucagaaugcagaugcauauguuuuuguggggacaucaagauauagcaagaaguucaagccggaaauagcaacaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauugggaaauguccaaaguauguaaaaagcacaaaauuaagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaaucuaaauaaaaaaguugaugaugguuuccuggacauuuggacuuacaaugccgaacuguugguucuauuggaaaaugaaagaacuuuggacuaucacgauucaaaugugaagaacuuguaugaaaaaguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggaucuaccagauuuuggcgaucuauucaacugucgccaguucauugguacugguagucucccugggggcaaucagcuucuggaugugcucuaaugggucucuacaguguagaauauguauuuaa

SEQ ID NO: 44418 - RNA, 1701 nt, Artificial Sequence
  hemagglutinin__InfluenzaA__EPI813817
augaaggcaauacuaguaguucugcuauauacauuuacaacugcaaaugcagacacauuauguauagguuaucaugcgaacaauucaacagacacuguagacacaguacuagaaaagaauguaacaguaacacacucuguuaaucuucuggaagacaagcauaacggaaaacuaugcaaacuaagagggguagccccauugcauuuggguaaauguaacauugcuggcuggauccugggaaauccagagugugaaucacucuccacagcaaguucaugguccuacauuguggaaacaucuaauucagacaauggaacguguuacccaggagauuucaucaauuaugaggagcuaagagagcaauugagcucagugucaucauuugaaagguuugaaauauuccccaaggcaaguucauggcccaaucaugacucgaacaaagguguaacggcagcauguccucacgcuggagcaaaaagcuucuacaaaaacuugauauggcuaguuaaaaaaggaaauucauacccaaagcucaaccaauccuacauuaaugauaaagggaaagaaguccucgugcuguggggcauucaccauccaucuacuacugcugaccaacaaagucucuaucagaaugcagaugcauauguuuuuguggggacaucaagauauagcaagaaguucaagccggaaauagcaacaagacccaaagugagggaucaagaagcgagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauugggaaauguccaaaguauguaaaaagcacaaaauuaagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaaaagaauagagaaucuaaauaaaaaaguugaugaugguuuccuggacauuuggacuuacaaugccgaacuguugguucuauuggaaaaugaaagaacuuuggacuaucacgauucaaaugugaagaacuuguaugaaaaaguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggaucuaccagauuuuggcgaucuauucaacugucgccaguucauugguacugguagucucccugggggcaaucagcuucuggaugugcucuaaugggucucuacaguguagaauauguauuuaa

SEQ ID NO: 44419 - RNA, 1701 nt, Artificial Sequence
  hemagglutinin__InfluenzaA__EPI466626
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaagagaauagagaauuuaaauaaaaaaguugaugauggauuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccgaaauacucagaggaagcaaaauuaaacagagaaaaaauagaugggguaaagcuggaaucaacaaggauuuaccagauuuuggcgaucuauucaacugucgccaguucagugguacugguagucucccugggggcaaucagcuucuggaugugcucuaaugggucucuacaguguagaauauguauuuaa

SEQ ID NO: 44420 - RNA, 1701 nt, Artificial Sequence
  hemagglutinin__InfluenzaA__EPI541966
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugaaucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaagagaauagagaauuuaaauaaaaaaguugaugauggauuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccgaaauacucagaggaagcaaaauuaaacagagaaaaaauagaugggguaaagcuggaaucaacaaggauuuaccagauuuuggcgaucuauucaacugucgccaguucagugguacugguagucucccugggggcaaucagcuucuggaugugcucuaaugggucucuacaguguagaauauguauuuaa

SEQ ID NO: 44421 - RNA, 1701 nt, Artificial Sequence
  hemagglutinin__InfluenzaA__EPI652003
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugaaucgaacaaagguguaacggcagcauguccucacgcuggagcaaaaagcuucuacaaaaauuuaauauggcuaguuaaaaaaggaaauucauacccaaagcucagccaauccuacauuaaugauaaagggaaagaaguccucgugcuguggggcauucaccauccaccuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaguauguaaaaagcacaaaauugagacuggccacaggauugaggaaugucccgucuauucaaucuagaggccuauucggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguggguaaagaguucaaccaccuggaaaagagaauagagaauuuaaauaaaaaaguugaugauggauuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccgaaauacucagaggaagcaaaauuaaacagagaaaaaauagaugggguaaagcuggaaucaacaaggauuuaccagauuuuggcgaucuauucaacugucgccaguucagugguacugguagucucccugggggcaaucagcuucuggaugugcucuaaugggucucuacaguguagaauauguauuuaa

SEQ ID NO: 44422 - RNA, 1701 nt, Artificial Sequence
  hemagglutinin__InfluenzaA__EPI291877
augaaagcaauaauaguagucuugcuauauacauuugcaacugcagaugcugacacauuauguauaggcuaucaugcaaauaauucaacugacacuguugacacaguacuagaaaagaauguaacaguaacacacucuguuaacauucuagaaaacaagcaugacgggaaacuauguaaacuaagagggguagccccauugcauuuggguaaauguaacauugcuggauggcucuugggaaacccagagugugaaucacuauucgcagcaagcucauggucauacauaguggaaacgccuaauucagacaaugggacauguuacccaggagauuucaucaauuaugaggagcuaagagagcauuugagcucugugucaucauuugaaagguuugagauauuccccaaggcaaauucauggccuaaucaugauacgaauaagggggugacggcagcauguccuuaugcuggagcaaacagcuuuuacagaaauuuaauauggcuaguaaaaaaaggaaauucauacccaaagcucagcaaauccuacauuaacaauaagaagaaggaaguccucgugauauggggcauccaccauccaccuaccaguauugaccaacaaacucucuaccagaaugcagaugccuauguuuuugugggaucaucaaaauacagcaaaagauucaaaccagaaauagcagcaagacccaaggugagggaucaagcaggaaggauggauuauuacuggacacuaauagaaccuggagacacaauaacauucgaagcaacuggaaaucuagugguaccaagauaugccuucgcaaugaaaagaggcucuggaucugguauuaucguuucagaugcaccaguccacgacuguaauacgacuugucaaacacccaaaggugcuauaaacaccagccuuccauuucagaauauacauccagucacaauuggggaauguccaaaauaugucaaaagcacaaaauugaggauggcuacaggauuaagaaauaucccgucuauucaaucaagaggccuauuuggggccauugcuggauucauugaagggggguggacaggaaugauagauggaugguacgguuaccaccaucaaaaugagcaggggucaggauaugcagccgaccaaaagagcacacagaaugccauugacgggaucacuaacaaaguaaauucuauuauugaaaagaugaacacacaauucacagcaguggguaaagaauucagccaauuggaaaaaagaauagagaguuuaaacaauaagguugaugauggauuccuagauauuuggacuuacaaugccgaacugcugguucuauuggaaaaugaaagaacucuggauuaucacgauucaaaugugaagaaccuauaugaaaaaguaagaagccagcuaaaaaacaaugccaaagaaauuggaaauggcugcuuugaauuuuaccacaaaugcgauaacacgugcauggagagugucaaaaaugggacuuaugauuacccaaaauacucagaagaagcaaagcuaaauagagaggagauagaugggauaaagcuggaaucagcaaggauuuaccagauuuuggcgaucuauucaacugucgccagcucauugguacuguuagucucucugggggcagucagcuucuggaugugcuccaaugggucuuuacagugcagaauauguaucuaa

SEQ ID NO: 44423 - RNA, 1701 nt, Artificial Sequence
  hemagglutinin__InfluenzaA__ABR29595
augaaggcaauacuauuagucuugcuauauacauuuacagccgcaaaugcagacacauuauguauagguuaccaugcaaauaauucaacugacacuguugauacaguacuagaaaagaauguaacaguaacacacucuguuaaccuucuagaagacagacauaacggaaaacuauguaaacuaaggggaguagccccauugcauuuggguaaauguaacauugcuggauggcuccugggaaacccagaaugugaauuacuauucacagcaagcucauggucuuacauuguggaaacaucuaacucagacaaugggacauguuacccaggagauuucaucaauuaugaagagcuaagagagcaguugagcucagugucaucauuugaaagauuugagauauuccccaaggcaaguucauggcccaaucaugaaacgaacagaggugugacggcagcaugcccuuaugcuggagcaaacagcuucuacagaaauuuaauauggcugguaaaaaaaggaaauucauacccaaagcucagcaaauccuauguuaacaauaaggagaaggaaguccucgugcuauggggcauucaccauccaccuaccaguacugaccaacaaagucucuaccagaaugcagaugccuauguuuuuguggggucaucaaaauacaacaagaaauucaagccagaaauagcaacaagacccaaggugagaggucaagcagggagaaugaacuauuacuggacacuaguagagccuggagacacaauaacauucgaagcaacuggaaaucuagugguaccaagauaugccuucgcaaugaaaagagguucuggaucugguauuaucauuucagauacaccaguccacgauuguaauacgacuugucaaacacccaaaggugcuauaaacaccagccucccauuucagaauauacauccagucacaauuggagaauguccaaaauaugucaaaagcacaaaauugagaauggcuacaggacuaaggaauaucccgucuauucaaucuagaggucuguuuggagccauugcuggcuuuauugaggggggauggacaggaaugauagauggaugguacgguuaucaccaucaaaaugagcagggaucaggauaugcagcugaccgaaagagcacacagaaugccauugacgggaucacuaacaaaguaaacucuguuauugaaaagaugaacacacaauucacagcaguggguaaagaauucaaccaccuggaaaaaagaauagagaauuuaaacaaaaagguugaugaugguuuucuggauguuuggacuuacaaugccgaacuguugguucuauuggaaaaugaaagaacuuuggauuaccaugacucaaaugugaagaaccuauaugagaaaguaagaagccagcuaaaaaacaaugccaaggaaauuggaaauggcugcuuugaauuuuaccacaaaugugaugacacgugcauggagagcgucaaaaaugggacuuaugauuacccaaaauacucagaagaaucaaaacuaaacagagaggaaauagaugggguaaagcuggaaucaacaaggauuuaccagauuuuggcgaucuauucaacugucgccaguucauugguacuguuagucucccugggggcaaucagcuucuggaugugcuccaaugggucuuuacagugcagaauauguauuuaa

SEQ ID NO: 44424 - RNA, 1701 nt, Artificial Sequence
  hemagglutinin__InfluenzaA__EPI291885
augaaggcaauaauaguagucuugcuacauacauuugcaacugcagaugcugacacauuauguauaggcuaucaugcaaauaauucaacugacacuguugacacgguacuagaaaagaauguaacaguaacacacucuguuaaccuucuagaaaccaagcaugacggaaaacuauguaaccuaaaagggguagccccauugcauuuggguaaauguaacauugcuggauggcucuugggaaacccagagugugaaucacuauucacagcaagcucaugguccuacauaguggaaacgccuaauucagacaaugggacauguuacccaggaaauuucaucaauuaugaggagcuaagagagcauuugagcucugugucgucauuugaaagguuugagauauuccccaaggcaaauucauggcccaaccaugauacgaauaagggggugacggcagcaugcccuuaugcuggggcaaacagcuuuuacagaaauuuaauauggcuaguaaaaaaaggaaauucauacccaaagcucagcaaauccuacauuaacaacaagaagaaggaaguccucgugauauggggcauccaccauccacccaccagcacugaucaacaaacucucuaccagaaugcagaugccuauguuuuugugggaucaucaaaauacagcaaaagauucgagccagaaauagcagcaagacccaaggugaggaaucaagcaggaagaaugaacuauuacuggacacuaauagaaccuggagacacaauaacauucgaagcaacuggaaaucuagugguaccaagauaugccuucgcaaugagaagaggcucuggaucugguauuaucguuucagaugcaccaguccacgauuguaauacgacuugucaaacacccaaaggugcuauaaacaccagccuuccauuucagaauauacauccagucacaauuggagaauguccaaaauaugucaaaagcacaaaauugaggauggcuacaggauuaagaaauaucccgucuauucaaucaagaggccuauuuggggccauugcuggcuuccuugaagggggguggacaggaaugauagauggaugguacgguuaccaccaucaaaaugagcagggaucaggauaugcagccgaccaaaagagcacacagaacgccauugacgggaucacuaacaaaguaaauucuauuauugaaaagaugaacacacaauucacagcaguggguaaagaauucagccaauuggaaaaaagaauagagaguuuaaacaauaaggucgaugauggguuccuagacauuuggacuuacaaugccgaaaugcugguucuauuggaaaaugaaagaacucuggauuaucacgauucaaaugugaagaaccuauaugaaaaaguaagaagccagcuaaaaaacaaugccaaagaaauuggaaauggcugcuuugaauuuuaccacaaaugcgauaacacgugcauggagagugucaaaaaugggacuuaugauuacccaaaauacucagaagaagcaaagcuaaauagagaggagauagaugggguaaagcuggaaucagcaagaauuuaccagauuuuggcgaucuauucaacugucgccagcucauugguacuguuagucucucugggggcagucaguuucuggaugugcuccaaugggucuuuacagugcagaauauguaucuaa

SEQ ID NO: 44425 - RNA, 1701 nt, Artificial Sequence; identical to SEQ ID NO: 33160
  hemagglutinin__InfluenzaA__EPI176515

SEQ ID NO: 44426 - RNA, 1701 nt, Artificial Sequence; identical to SEQ ID NO: 33616
  hemagglutinin__InfluenzaA__EPI189182

SEQ ID NO: 44427 - RNA, 1701 nt, Artificial Sequence
  hemagglutinin__InfluenzaA__EPI180574
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucgucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgaaauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaacuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 44428 - RNA, 1701 nt, Artificial Sequence
  hemagglutinin__InfluenzaA__EPI377499
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugaacugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggaauggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaccaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcggaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44429 - RNA, 1701 nt, Artificial Sequence
  hemagglutinin__InfluenzaA__EPI346916
augaaggcaauacuaguaguccugcuauauacauuuacaacugcaacugccgacacauuauguauagguuaucaugcgaacaauucaacugacaccguagacacaguacuagaaaagaauguaacaguaacacacucugucaaccuucuagaaaacaggcauaaugggaaacuauguaaacuaagagggguagcuccauugcauuuggguaaauguaacauugcuggauggcuccugggaaauccagagugugaaucacucuccacagcaagcucaugguccuacauuguggaaacauccaauucagacaaugggacguguuacccaggagauuucaucaauuaugaggagcuaagagagcaguugagcucagugucaucguuugaaagauuugagauauuccccaagacaaguucauggcccaaucaugacacgaacagaggugugacggcagcauguccucaugauggaacaaacagcuucuacagaaauuuaauauggcuaguaaaaaagggaaauucauacccaaagaucaacaaauccuacauuaacaauaaagagaaagaaauucucgugcuaugggccauucaccauccaucuaccagugccgaccaacaaagucucuaccaaaaugcagaugccuauguuuuugugggaucaucaagauacagcaggaaguucgagccagaaguagcaacaagacccaaggugagggaccaagcagggagaaugaacuauuacuggacacuaguagaaccuggagacaagauaacauuugaagcaacuggaaaucuagugguaccgagauaugcuuucgcauugaaaagaaauucuggaucugguaucaucauuucagauacaucaguccacgauugugauacgaauugucagacacccaauggugcuauaaacaccagccucccauuucaaaauauacauccagucacaauuggagaauguccaaaauauguaaaaaguacuaaacugagaauggccacaggauuaagaaauaucccgucuauccaaucuagaggccuguuuggggccauugcuggcuuuaucgaagggggcuggacaggaaugauagauggaugguacgguuaucaccaucaaaaugagcagggaucaggauaugcagccgaccugaagagcacacagaaugccauugacgggaucacuaacaagguaaauucuguuauugaaaagaugaacacacaauucacagcaguagguaaagaguucagccacuuggaaagaagaauagagaauuuaaauaaaaagguugaugaugguuuucuagauauuuggacuuacaaugccgaacuguugguucuauuagaaaaugaaagaacuuuggauuaccacgacucaaaugugaaaaacuuauaugaaaaagugagaagccagcugaaaaacaaugccaaggaaauuggaaauggcugcuuugaauuuuaccacaaaugugaugacaugugcauggaaagcgucaaaaauggaacuuaugauuacccuaaauacucagaggaagcaaaacuaaacagagaggaaauagauggggugaaguuggaaucaacaaggauuuaccaaauuuuggcgaucuauucaacggucgccaguucauugguacuaguagucucccugggggcaaucaguuucuggaugugcucuaaugggucgcuacagugcagaauauguauuuaa

SEQ ID NO: 44430 - RNA, 1689 nt, Artificial Sequence; identical to SEQ ID NO: 33787
  hemagglutinin__InfluenzaA__ACV49600

SEQ ID NO: 44431 - RNA, 1701 nt, Artificial Sequence; identical to SEQ ID NO: 32904
  hemagglutinin__InfluenzaA__BAF48361

SEQ ID NO: 44432 - RNA, 1701 nt, Artificial Sequence
  hemagglutinin__InfluenzaA__EPI507594
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcaaaaggggaucuaauaguaguuucuuuaguagauuaaauugguugacccacuuaaacuucaaauacccagcauugaacgugacuaugccaaacaaugaacaauuugacaaauuguacauuugggggguucaccacccgguuacggacaaggaccaaaucuuccuguaugcucaaucaucaggaagaaucacaguaucuaccaaaagaagccaacaagcuguaaucccgaauaucggauuuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacacugaaauuggcaacaggaaugcgaaauguaccagagaaacaaacuagaggcauauuuggcgcaauagcggguuucauagaaaaugguugggagggaaugguggaugguugguacgguuucaggcaucaaaauuuugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44433 - RNA, 1701 nt, Artificial Sequence
  hemagglutinin__InfluenzaA__EPI461953
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcauaaggggaucuaauaguaguuucuuuaguagauuaaauugguugacccacuuaaacuucaaauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacacugaaauuggcaacaggaaugcgaaauguaccagagaaacaaacuagaggcauauuuggcgcaauagcggguuucauagaaaaugguugggagggaaugguggaugguugguacgguuucaggcaucaaaauuuugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44434 - RNA, 1701 nt, Artificial Sequence
  hemagglutinin__InfluenzaA__EPI461953/m1
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcaaaaggggaucuaauaguaguuucuuuaguagauuaaauugguugacccacuuaaacuucaaauacccagcauugaacgugacuaugccaaacaaugaacaauuugacaaauuguacauuugggggguucaccacccgguuacggacaaggaccaaaucuuccuguaugcucaaucaucaggaagaaucacaguaucuaccaaaagaagccaacaagcuguaaucccgaauaucggauauagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacacugaaauuggcaacaggaaugcgaaauguaccagagaaacaaacuagaggcauauuuggcgcaauagcggguuucauagaaaaugguugggagggaaugguggaugguugguacgguuucaggcaucaaaauuuugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44435 - RNA, 1701 nt, Artificial Sequence
  hemagglutinin__InfluenzaA__EPI668105
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggggaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuucccguaugcucaaucaucaggaagaaucacaguaucuaccaaaagaagccaacaagcuguaaucccaaauaucggaucuagacccagaauaagggguaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 44436 - RNA, 1701 nt, Artificial Sequence
  hemagglutinin__InfluenzaA__EPI578446
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuucccguaugcucaaucaucaggaagaaucacaguaucuaccaaaagaagccaacaagcuguaaucccaaauaucggaucuagacccagaauaagggguaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 44437 - RNA, 1701 nt, Artificial Sequence
  hemagglutinin__InfluenzaA__EPI551882
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcgcccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauauaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44438 - RNA, 1701 nt, Artificial Sequence
  hemagglutinin__InfluenzaA__EPI344389
augaagacuaucauugcuuuuagcugcauuuuaugucugauuuucgcucaaaaacuucccggaagugacaacagcauggcaacgcugugccugggacaccaugcagugccaaacggaacauuagugaaaacaaucacggaugaccaaauugaagugacuaaugcuacugagcugguccagaguuccucaacaggcagaauaugcaacaguccucaccaaauccuugaugggaaaaauugcacacugauagaugcucuauugggggacccucauugugaugaccuccaaaacaaggaaugggaccuuuuuguugaacgaagcacagccuacagcaacuguuacccuuauuaugugccagauuaugccacccuuaggucacuaguugccucaucuggcaaccuggaauuuacccaagaaagcuucaauuggacuggaguugcucaagacggaucaagcuaugccugcagaaggggaucuguuaacaguuucuuuaguagauugaauugguuguauaacuugaauuacaaguauccagagcagaacguaacuaugccaaacaaugacaaauuugacaaauuguacauuugggggguucaccacccggguacggacaaggaccaaaccaaucuauauguccaagcaucagggagaguuauagucucuaccaaaagaagccaacaaacuguaaucccgaauaucgggucuagacccuggguaaggggugucuccagcauaauaagcaucuauuggacgauaguaaaaccgggagacauacuuuugauuaacagcacagggaaucuaauugccccucgggguuacuucaaaauacaaagugggaaaagcucaauaaugagaucagaugcacacauugaugaaugcaauucugaaugcauuacuccaaauggaagcauucccaaugacaaaccuuuucaaaauguaaacaagaucacauauggagccugucccagauauguuaagcaaaacacccugaaauuggcaacaggaaugcggaauguaccagagaaacaaacuagaggcauauucggcgcaauugcagguuucauagaaaaugguugggagggaaugguagacgguugguacgguuucaggcaucagaauucugaaggcacaggacaagcagcagaucuuaaaagcacucaagcagcaaucaaccaaaucaccgggaaacuaaauagaguaaucaagaaaacgaacgagaaauuccaucaaaucgaaaaagaauucucagaaguagaagggagaauucaggaccuagagaaauacguugaagacaccaaaauagaucucuggucuuacaacgcugagcuucuuguugcccuggagaaccaacauacaauugauuuaaccgacucagagaugagcaaacuguucgaaagaacaagaaggcaacugcgggaaaaugcugaggacaugggcaaugguugcuucaaaauauaccacaaaugugacaaugccugcauaggaucaaucagaaauggaacuuaugaccaugauauauacagaaacgaggcauuaaacaaucgguuccagaucaaagguguucagcuaaagucaggauacaaagauuggauccuauggauuuccuuugccauaucaugcuuuuugcuuuguguuguucugcugggguucauuaugugggccugccaaaaaggcaacauuaggugcaacauuugcauuuga

SEQ ID NO: 44439 - RNA, 1701 nt, Artificial Sequence
  hemagglutinin__InfluenzaA__EPI348782
augaagacuaucauugcuuuuagcugcauuuuaugucugauuuucgcucaaaaacuucccggaagugacaacagcauggcaacgcugugccugggacaccaugcagugccaaacggaacauuagugaaaacaaucacggaugaccaaauugaagugacuaaugcuacugagcugguccagaguuccucaacaggcagaauaugcaacaguccucaccaaauccuugaugggaaaaauugcacacugauagaugcucuauugggggacccucauugugaugaccuccaaaacaaggaaugggaccuuuuuguugaacgaagcacagccuacagcaacuguuacccuuauuaugugccagauuaugccacccuuaggucacuaguugccucaucuggcaaccuggaauuuacccaagaaagcuucaauuggacuggaguugcucaagacggaucaagcuaugccugcagaaggggaucuguuaacaguuucuuuaguagauugaauugguuguauaaauugaauuacaaguauccagagcagaacguaacuaugccaaacaaugacaaauuugacaaauuguacauuugggggguucaccacccggguacggacaaggaccaaaccaauauauauguccaagcaucagggagaguuauagucucuaccaaaagaagccaacaaacuguaaucccgaauaucgggucuagacccuggguaaggggugucuccagcauaauaagcaucuauuggacgauaguaaaaccgggagacauacuuuugauuaacagcacagggaaucuaauugccccucgggguuacuucaaaauacaaagugggaaaagcucaauaaugagaucagaugcacacauugaugaaugcaauucugaaugcauuacuccaaauggaagcauucccaaugacaaaccuuuucaaaauguaaacaagaucacauauggagccugucccagauauguuaagcaaaacacccugaaauuggcaacaggaaugcggaauguaccagagaaacaaacuagaggcauauucggcgcaauugcagguuucauagaaaaugguugggagggaaugguagacgguugguacgguuucaggcaucagaauucugaaggcacaggacaagcagcagaucuuaaaagcacucaagcagcaaucaaccaaaucaccgggaaacuaaauagaguaaucaagaaaacgaacgagaaauuccaucaaaucgaaaaagaauucucagaaguagaagggagaauucaggaccuagagaaauacguugaagacaccaaaauagaucucuggucuuacaacgcugagcuucuuguugcccuggagaaccaacauacaauugauuuaaccgacucagagaugagcaaacuguucgaaagaacaagaaggcaacugcgggaaaaugcugaggacaugggcaaugguugcuucaaaauauaccacaaaugugacaaugccugcauaggaucaaucagaaauggaacuuaugaccaugauauauacagaaacgaggcauuaaacaaucgguuccagaucaaagguguucagcuaaagucaggauacaaagauuggauccuauggauuuccuuugccauaucaugcuuuuugcuuuguguuguucugcugggguucauuaugugggccugccaaaaaggcaacauuaggugcaacauuugcauuuga

SEQ ID NO: 44440 - RNA, 1701 nt, Artificial Sequence
  hemagglutinin__InfluenzaA__EPI642513
augaagacuaucauugcuuuuagcugcauucuaugucugauuuuugcucaaaaacuucccggaagugacaaaagcauggcaacgcugugccugggacaccaugcagugccaaacggaacauuagugaaaacaaucacggaugaccaaauugaagugacuaaugcuacugagcugguccagaguuccucaacaaguagaauaugcaacaguccucaccaaauccuugaugggaaaaacugcacacugauagaugcucuauugggggacccucauugugaugacuuccaaaacaagaaaugggaccuuuuuguugaacgaagcacagccuacagcaacuguuacccuuauuaugugccagauuaugccacccuuaggucacuaauugccucaucuggcaaccuggaauuuacccaagaaagcuucaauuggacuggaguugcucaagacggaucaagcuaugccugcagaagggguucuguuaacaguuucuuuaguagauugaauugguuguauaacuugaauuacaaguauccagaacagaacguaacuaugccaaacaaugacaaauuugacaaauuguacauuugggggguucaccacccggguacggacaaggaccaaaccaaccuauauguccaagcaucagggagaguuauagucucuaccaaaagaagccaacaaacuguaaucccgaauaucgggucuagacccuggguaaggggugucuccagcauaauaagcaucuauuggacgauaguaaaaccgggagacauacuuuugauuaacagcacagggaaucuaauugccccucgggguuacuucaaaauacaaagugggaaaagcucaauaaugagaucagaugcacacauugaugaaugcaauucugaaugcauuacuccaaauggaagcauucccaaugacaaaccuuuucaaaauguaaacaagaucacauauggagccugucccagauauguuaagcaaaacacccugaaguuggcaacaggaaugcggaauguaccagagaaacaaacuagaggcauauucggcgcaauugcagguuucauagaaaaugguugggagggaaugguagacgguugguacgguuucaggcaucagaauucugaaggcacaggacaagcagcagaucuuaaaagcacucaagcggcaaucaaccaaaucaccgggaaacuaaauagaguaaucaagaaaacgaacgagaaauuccaucaaaucgaaaaagaauucucagaaguagaagggagaauucaggaccuagagaaauacguugaagacacuaaaauagaucucuggucuuacaaugcugagcuucuuguugcccuggagaaccaacauacaauugauuuaaccgacucagagaugagcaaacuguucgaaagaacaagaaggcaacugcgggaaaaugcugaggacaugggcaaugguugcuuuaaaauauaccacaaaugugacaacgccugcauaggaucaaucagaaauggaacuuaugaccaugauauauacagaaacgaggcauuaaacaaucgguuucagaucaaagguguucagcuaaagucaggauacaaagauuggauccuauggauuuccuuugccauaucauguuuuuugcuuuguguuguucugcugggguucauuaugugggccugccaaaaaggcaacauuaggugcaacauuugcauuuaa

SEQ ID NO: 44441 - RNA, 1701 nt, Artificial Sequence
  hemagglutinin__InfluenzaA__EPI293965
augaagacuaucauugcuuuuagcugcauuuuaugucugauuuucgcucaaaaacuucccggaagugacaacagcauggcaacgcugugccugggacaccaugcagugccaaacggaacauuagugaaaacaaucacggaugaccaaauugaagugacuaaugcuacugagcugguccagaguuccucaacagguagaauaugcaacaguccucaccaaauccuugaugggaaaaauugcacacugauagaugcucuauugggagacccucauugugaugacuuccaaaacaaggaaugggaccuuuuuguugaacgaagcacagccuacagcaacuguuacccuuauuaugugccggauuaugccacccuuaggucacuaguugccucauccggcaaccuggaauuuacccaagaaagcuucaauuggacuggaguugcucaagacggaucaagcuaugccugcagaaggggaucuguuaacaguuucuuuaguagauugaauugguuguauaauuugaauuacaaguauccagagcagaacguaacuaugccaaacaaugacaaauuugacaaauuguacauuugggggguucaccacccggguacggacaaggaccaaaccaaccuauauguccaagcaucagggagaguuauagucucuaccaaaagaagccaacaaacuguaaucccgaauaucgggucuagacccuggguaaggggugucuccagcauaauaagcaucuauuggacgauaguaaaaccgggagacauacuuuugauuaacagcacagggaaucuaauugccccucgggguuacuucaaaauacaaagugggaaaagcucaauaaugagaucagaugcacacauugaugaaugcaauucugaaugcauuacuccaaauggaagcauucccaaugacaaaccuuuucaaaauguaaacaagaucacauauggagccugucccagauauguuaagcaaaacacccugaaauuggcaacaggaaugcggaauguaccagagaaacaaacuagaggcauauucggcgcaauugcagguuucauagaaaaugguugggagggaaugguagacgguugguacgguuucaggcaucagaauucugaaggcacaggacaagcagcagaucuuaaaagcacucaagcagcaaucaaccaaaucaccgggaaacuaaauagaguaaucaagaaaacgaacgagaaauuccaucaaaucgaaaaagaauucucagaaguagaagggagaauucaggaccuagagaaauacguugaagacacuaaaauagaucucuggucuuacaacgcggagcuucuuguugcccuggagaaccaacauacaauugauuuaaccgacucagagaugagcaaacuguucgaaagaacaagaaggcaacugcgggaaaaugcugaggacaugggcaaugguugcuucaaaauauaccacaaaugugacaaugccugcauaggaucaaucagaaauggaacuuaugaccaugauauauacagaaacgaggcauuaaacaaucgguuccagaucaaagguguucagcuaaagucaggauacaaagauuggauccuauggauuuccuuugccauaucaugcuuuuugcuuuguguuguucugcugggguucauuaugugggccugccaaaaaggcaacauuaggugcaacauuugcauuuga

SEQ ID NO: 44442 - RNA, 1701 nt, Artificial Sequence
  hemagglutinin__InfluenzaA__EPI465400
augaagacuaucauugcuuuuagcugcauuuuaugucugauuuucgcucaaaaacuucccggaagugacaacagcauggcaacgcugugccugggacaccaugcagugccaaacggaacauuagugaaaacaaucacggaugaccaaauugaagugacuaaugcuacugagcugguccagaguuccucaacagguagaauaugcaacaguccucaccaaauccuugaugggaaaaauugcacacugauagaugcucuauugggagacccucauugugaugacuuccaaaacaaggaaugggaccuuuuuguugaacgaagcacagccuacagcaacuguuacccuuauuaugugccggauuaugccacccuuaggucacuaguugccucauccggcaaccuggaauuuacccaagaaagcuucaauuggacuggaguugcucaagacggaucaagcuaugccugcagaaggggaucuguuaacaguuucuuuaguagauugaauugguuguauaauuugaauuacaaguauccagagcagaacguaacuaugccaaacaaugacaaauuugacaaauuguacauuugggggguucaccacccggguacggacaaggaccaaaccaaacuauauguccaagcaucagggagaguuauagucucuaccaaaagaagccaacaaacuguaaucccgaauaucgggucuagacccuggguaaggggugucuccagcauaauaagcaucuauuggacgauaguaaaaccgggagacauacuuuugauuaacagcacagggaaucuaauugccccucgggguuacuucaaaauacaaagugggaaaagcucaauaaugagaucagaugcacacauugaugaaugcaauucugaaugcauuacuccaaauggaagcauucccaaugacaaaccuuuucaaaauguaaacaagaucacauauggagccugucccagauauguuaagcaaaacacccugaaauuggcaacaggaaugcggaauguaccagagaaacaaacuagaggcauauucggcgcaauugcagguuucauagaaaaugguugggagggaaugguagacgguugguacgguuucaggcaucagaauucugaaggcacaggacaagcagcagaucuuaaaagcacucaagcagcaaucaaccaaaucaccgggaaacuaaauagaguaaucaagaaaacgaacgagaaauuccaucaaaucgaaaaagaauucucagaaguagaagggagaauucaggaccuagagaaauacguugaagacacuaaaauagaucucuggucuuacaacgcggagcuucuuguugcccuggagaaccaacauacaauugauuuaaccgacucagagaugagcaaacuguucgaaagaacaagaaggcaacugcgggaaaaugcugaggacaugggcaaugguugcuucaaaauauaccacaaaugugacaaugccugcauaggaucaaucagaaauggaacuuaugaccaugauauauacagaaacgaggcauuaaacaaucgguuccagaucaaagguguucagcuaaagucaggauacaaagauuggauccuauggauuuccuuugccauaucaugcuuuuugcuuuguguuguucugcugggguucauuaugugggccugccaaaaaggcaacauuaggugcaacauuugcauuuga

SEQ ID NO: 44443 - RNA, 1701 nt, Artificial Sequence
  hemagglutinin__InfluenzaA__EPI328898
augaagacuaucauugcuuuuagcugcauuuuaugucugauuuucgcucaaaaacuucccggaagugacaacagcauggcaacgcugugccugggacaccaugcagugccaaacggaacauuagugaaaacaaucacggaugaccaaauugaagugacuaaugcuacugagcugguccagaguuccucaacagguagaauaugcaacaguccucaccaaauccuugaugggaaaaauugcacacugauagaugcucuauugggagacccucauugugaugacuuccaaaacaaggaaugggaccuuuuuguugaacgaagcacagccuacagcaacuguuacccuuauuaugugccggauuaugccacccuuaggucacuaguugccucauccggcaaccuggaauuuacccaagaaagcuucaauuggacuggaguugcucaagacggaucaagcuaugccugcagaaggggaucuguuaacaguuucuuuaguagauugaauugguuguauaauuugaauuacaaguauccagagcagaacguaacuaugccaaacaaugacaaauuugacaaauuguacauuugggggguucaccacccggguacggacaaggaccaaaccaaaauauauguccaagcaucagggagaguuauagucucuaccaaaagaagccaacaaacuguaaucccgaauaucgggucuagacccuggguaaggggugucuccagcauaauaagcaucuauuggacgauaguaaaaccgggagacauacuuuugauuaacagcacagggaaucuaauugccccucgggguuacuucaaaauacaaagugggaaaagcucaauaaugagaucagaugcacacauugaugaaugcaauucugaaugcauuacuccaaauggaagcauucccaaugacaaaccuuuucaaaauguaaacaagaucacauauggagccugucccagauauguuaagcaaaacacccugaaauuggcaacaggaaugcggaauguaccagagaaacaaacuagaggcauauucggcgcaauugcagguuucauagaaaaugguugggagggaaugguagacgguugguacgguuucaggcaucagaauucugaaggcacaggacaagcagcagaucuuaaaagcacucaagcagcaaucaaccaaaucaccgggaaacuaaauagaguaaucaagaaaacgaacgagaaauuccaccaaaucgaaaaagaauucucagaaguagaagggagaauucaggaccuagagaaauacguugaagacacuaaaauagaucucuggucuuacaacgcggagcuucuuguugcccuggagaaccaacauacaauugauuuaaccgacucagagaugagcaaacuguucgaaagaacaagaaggcaacugcgggaaaaugcugaggacaugggcaaugguugcuucaaaauauaccacaaaugugacaaugccugcauaggaucaaucagaaauggaacuuaugaccaugauauauacagaaacgaggcauuaaacaaucgguuccagaucaaagguguucagcuaaagucaggauacaaagauuggauccuauggauuuccuuugccauaucaugcuuuuugcuuuguguuguucugcugggguucauuaugugggccugccaaaaaggcaacauuaggugcaacauuugcauuuga

SEQ ID NO: 44444 - RNA, 1701 nt, Artificial Sequence
  hemagglutinin__InfluenzaA__EPI328900
augaagacuaucauugcuuuuagcugcauuuuaugucugauuuucgcucaaaaacuucccggaagugacaacagcauggcaacgcugugccugggacaccaugcagugccaaacggaacauuagugaaaacaaucacggaugaccaaauugaagugacuaaugcuacugagcugguccagaguuccucaacagguagaauaugcaacaguccucaccaaauccuugaugggaaaaauugcacacugauagaugcucuauugggagacccucauugugaugacuuccaaaacaaggaaugggaccuuuuuguugaacgaagcacagccuacagcaacuguuacccuuauuaugugccggauuaugccacccuuaggucacuaguugccucauccggcaaccuggaauuuacccaagaaagcuucaauuggacuggaguugcucaagacggaucaagcuaugccugcagaaggggaucuguuaacaguuucuuuaguagauugaauugguuguauaauuugaauuacaaguauccagagcagaacguaacuaugccaaacaaugacaaauuugacaaauuguacauuugggggguucaccacccggguacggacaaggaccaaaccaaaauauauguccaagcaucagggagaguuauagucucuaccaaaagaagccaacaaacuguaaucccgaauaucgggucuagacccuggguaaggggugucuccagcauaauaagcaucuauuggacgauaguaaaaccgggagacauacuuuugauuaacagcacagggaaucuaauugccccucgggguuacuucaaaauacaaagugggaaaagcucaauaaugagaucagaugcacacauugaugaaugcaauucugaaugcauuacuccaaauggaagcauucccaaugacaaaccuuuucaaaauguaaacaagaucacauauggagccugucccagauauguuaagcaaaacacccugaaauuggcaacaggaaugcggaauguaccagagaaacaaacuagaggcauauucggcgcaauugcagguuucauagaaaaugguugggagggaaugguagacgguugguacgguuucaggcaucagaauucugaaggcacaggacaagcagcagaucuuaaaagcacucaagcagcaaucaaccaaaucaccgggaaacuaaauagaguaaucaagaaaacgaacgagaaauuccaucaaaucgaaaaagaauucucagaaguagaagggagaauucaggaccuagagaaauacguugaagacacuaaaauagaucucuggucuuacaacgcggagcuucuuguugcccuggagaaccaacauacaauugauuuaaccgacucagagaugagcaaacuguucgaaagaacaagaaggcaacugcgggaaaaugcugaggacaugggcaaugguugcuucaaaauauaccacaaaugugacaaugccugcauaggaucaaucagaaauggaacuuaugaccaugauauauacagaaacgaggcauuaaacaaucgguuccagaucaaagguguucagcuaaagucaggauacaaagauuggauccuauggauuuccuuugccauaucaugcuuuuugcuuuguguuguucugcugggguucauuaugugggccugccaaaaaggcaacauuaggugcaacauuugcauuuga

SEQ ID NO: 44445 - RNA, 1701 nt, Artificial Sequence
  hemagglutinin__InfluenzaA__EPI574644
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggaaaaaacugcacacuaauagaugcucuauugggagacccucagugugauggcuuucaaaauaagagaugggaccuuuuuguugaacgaagcaaagccuacagcaacuguuacccuuaugaugugccggauuaugccucccuuaggucacuaguugccucauccggcacacuggaguuuaacgaugaaagcuucaauugggcuggagucacucaaaacggaacaaguucugcuugcauaaggggaucuaauaguaguuucuuuaguagauuaaauugguugacccacucaaacuucaaauacccagcauugaacgugacuaugccaaacaaugaacaauuugacaaauuguacauuugggggguucaccacccggguacagacaaggaccaaaucuuccuguaugcucacucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaagucugaaugcaucacuccaaauggaagcauucccaaugacaagccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugaaggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugagaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcuuuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44446 - RNA, 1701 nt, Artificial Sequence
  hemagglutinin__InfluenzaA__EPI563212
augaagacuaucauugcuuugagcuacauucuaugucugguuuucgcucaaaaaauuccuggaaaugacaauaacacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuucccguaugcucaaucaucaggaagaaucacaguaucuaccaaaagaagccaacaagcuguaaucccaaauaucggaucuagacccagaauaagggguaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44447 - RNA, 1701 nt, Artificial Sequence; identical to SEQ ID NO: 44446
  hemagglutinin__InfluenzaA__EPI553999

SEQ ID NO: 44448 - RNA, 1701 nt, Artificial Sequence
  hemagglutinin__InfluenzaA__EPI551570
augaagacuaucauugcuuugagcuacauucuaugucugguuuucgcucaaaaaauuccuggaaaugacaauaacacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaaugugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44449 - RNA, 1701 nt, Artificial Sequence
  hemagglutinin__InfluenzaA__EPI629738
augaagacuaucauugcuuugagcuacauucuaugucugguuuucgcucaaaaaauuccuggaaaugacaauaacacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuucccguaugcucaaucaucaggaagaaucauaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44450 - RNA, 1701 nt, Artificial Sequence
  hemagglutinin__InfluenzaA__EPI631887
augaagacuaucauugcuuugagcuacauucuaugucugguuuucgcucaaaaaauuccuggaaaugacaauaacacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuucccguaugcucaaucaucaggaagaaucauaguaucuaccaaaagaagccaacaagcuguaaucccaaauaucggaucuagacccagaauaagggauagcccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44451 - RNA, 1701 nt, Artificial Sequence
  hemagglutinin__InfluenzaA__EPI577026
augaagacuaucauugcuuugagcuacauucuaugucugguuuucgcucaaaaaauuccuggaaaugacaauaacacggcaacgcugugccuugggcaccaugcaguaccaaacggaacgauagugaaaacaaucacaaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuucccguaugcucaaucaucaggaagaaucacaguaucuaccaaaagaagccaacaagcuguaaucccaaauaucggaucuagacccagaauaagggguaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauagaaucaauaagaaauggaacuuaugaccacaauguguacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44452 - RNA, 1701 nt, Artificial Sequence; identical to SEQ ID NO: 40551
  hemagglutinin__InfluenzaA__EPI404927

SEQ ID NO: 44453 - RNA, 1701 nt, Artificial Sequence
  hemagglutinin__InfluenzaA__EPI489319
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucugcuugcaaaaggggaucuaauaguaguuucuuuaguagauuaaauugguugacccacuuaaacuucaaauacccagcauugaacgugacuaugccaaacaaugagcaauuugacaaauuguacauuugggggguucaccacccggguacggacaaggaccaaaucuucccguaugcucaaucaucaggaagaaucacaguaucuaccaaaagaagccaacaagcuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaaaucugaauguaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44454 - RNA, 1701 nt, Artificial Sequence; identical to SEQ ID NO: 42931
  hemagglutinin__InfluenzaA__EPI530647

SEQ ID NO: 44455 - RNA, 1701 nt, Artificial Sequence
  hemagglutinin__InfluenzaA__EPI541083
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccaaaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauuccuaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauucuauggauuuccuuugccauaucauguuuuuugcuuuguguugcuuuguugggguucaucaugugggccugccaaaagggcaacauuaggugcaacauuugcauuuga

SEQ ID NO: 44456 - RNA, 1701 nt, Artificial Sequence
  hemagglutinin__InfluenzaA__EPI684315
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccaaaucuucccguaugcucaaucaucaggaagaaucauaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuccagaucaagggaguugagcugaagucaggguacaaagauuggauucuauggauuuccuuugccauaucauguuuuuugcuuuguguugcuuuguugggguucaucaugugggccugccaaaagggcaacauuaggugcaacauuugcauuuga

SEQ ID NO: 44457 - RNA, 1701 nt, Artificial Sequence
  hemagglutinin__InfluenzaA__EPI614462
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaucaucaggaagaaucacaguaucuaccagaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauuaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44458 - RNA, 1701 nt, Artificial Sequence
  hemagglutinin__InfluenzaA__EPI541465
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaauaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaucaucaggaagaaucacaguaucuaccagaagaagccaacaagcuguaaucccgaauaucggaucuagacccagaauaagggguaucccuagcagaauaagcaucuauuggacaauaguaaaaccgggagacauacuuuugauuaacagcacagggaaucuaauugcuccuagggguuacuucaaaauacgaagugggaaaagcucaauuaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44459 - RNA, 1701 nt, Artificial Sequence
  hemagglutinin__InfluenzaA__EPI696967
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccgcuuaaacuccaaauacccagcauuaaacgugacuaugccaaacaaugaacaauuugacaaauuguacauuugggggguucaccacccggagacggacaaggaccaaaucuuccuguaugcacaaucaucaggaagaaucacaguaucuaccagaagaagccaacaagcuguaaucccgaauaucggaucuagacccagaauaagggguaucccuagcagaauaagcaucuauuggacaauaguaaaaccgggagacauacuuuugauuaacagcacagggaaucuaauugcuccuagggguuacuucaaaauacgaagugggaaaagcucaauuaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44460 - RNA, 1701 nt, Artificial Sequence
  hemagglutinin__InfluenzaA__EPI674597
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaauaguuucuuuaguagauuaaauugguugacccacuuaaacuccaaauacccagcauuaaacgugacuaugccaaacaaugaacaauuugacaaauuguacauuugggggguucaccacccgguuacggacaaggaccaaaucuuccuguaugcacaaucaucaggaagaaucacaguaucuaccagaagaagccaacaagcuguaaucccgaauaucggaucuagacccagaauaagggguaucccuagcagaauaagcaucuauuggacaauaguaaaaccgggagacauacuuuugauuaacagcacagggaaucuaauugcuccuagggguuacuucaaaauacgaagugggaaaagcucaauuaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44461 - RNA, 1701 nt, Artificial Sequence
  hemagglutinin__InfluenzaA__EPI530677
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaucaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44462 - RNA, 1701 nt, Artificial Sequence
  hemagglutinin__InfluenzaA__EPI530679
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuucaaauacccagcauuaaacgugacuaugccaaacaaugaacaauuugacaaauuguacauuugggggguucaccacccggguacggacaaggaccaaaucuuccuguaugcacaaucaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44463 - RNA, 1701 nt, Artificial Sequence; identical to SEQ ID NO: 30526
  hemagglutinin__InfluenzaA__AAG01785

SEQ ID NO: 44464 - RNA, 1701 nt, Artificial Sequence
  hemagglutinin__InfluenzaA__EPI814528
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcauaaggggaucuaauaguaguuucuuuaguagauuaaauugguugacccacuuaaacuccaaauacccagcauuaaacgugacuaugccaaacaaugaacaauuugacaaauuguacauuugggggguucaccacccggguacggacaaggaccaaaucuuccuguaugcacaaucaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucuaaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44465 - RNA, 1701 nt, Artificial Sequence
  hemagglutinin__InfluenzaA__EPI674736
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcagaaggggaucuaauaguaguuucuuuaguagauuaaauugguugacccacuuaaacuccaaauacccagcauuaaacgugacuaugccaaacaaugaacaauuugacaaauuguacauuugggggguucaccacccgguuacggacaaggaccaaaucuuccuguaugcacaaucaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44466 - RNA, 1701 nt, Artificial Sequence; identical to SEQ ID NO: 42931
  hemagglutinin__InfluenzaA__EPI614444

SEQ ID NO: 44467 - RNA, 1701 nt, Artificial Sequence
  hemagglutinin__InfluenzaA__EPI551814
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcagaaggggaucuaauaguaguuucuuuaguagauuaaauugguugacccgcuuaaacuccaaauacccagcauuaaacgugacuaugccaaacaaugaacaauuugacaaauuguacauuugggggguucaccacccgguuacggacaaggaccaaaucuuccuguaugcacaaucaucaggaagaaucacaguaucuaccaaaagaagccaacaagcuguaaucccgaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44468 - RNA, 1701 nt, Artificial Sequence
  hemagglutinin__InfluenzaA__EPI696955
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcagaaggggaucuaauaguaguuucuuuaguagauuaaauugguugacccacuuaaacuccaaauacccagcauuaaacgugacuaugccaaacaaugaacaauuugacaaauuguacauuugggggguucaccacccgguuacggacaaggaccaaaucuuccuguaugcacaaucaucaggaagaaucacaguaucuaccaaaagaagccaacaagcuguaaucccgaauaucggauauagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44469 - RNA, 1701 nt, Artificial Sequence
  hemagglutinin__InfluenzaA__EPI740790
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugagcugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauugggcuggagucacucaaaacggaacaaguucuucuugcagaaggggaucuaauaguaguuucuuuaguagauuaaauugguugacccacuuaaacuccaaauacccagcauuaaacgugacuaugccaaacaaugaacaauuugacaaauuguacauuugggggguucaccacccgguuacggacaaggaccaaaucuuccuguaugcacaaucaucaggaagaaucacaguaucuaccaaaagaagccaacaagcuguaaucccgaauaucggauuuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagagacaaacuagaggcauauuuggcgcaauagcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacaaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44470 - RNA, 1701 nt, Artificial Sequence; identical to SEQ ID NO: 44428
  hemagglutinin__InfluenzaA__EPI377499

SEQ ID NO: 44471 - RNA, 1701 nt, Artificial Sequence
  hemagglutinin__InfluenzaA__EPI391247
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugaacugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggaauggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccgguuacggacaaggaccaaaucuuccuguaugcucaaccaucaggaagaaucacaguaucuaccaaaagaagccaacaagcuguaaucccgaauaucggauuuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcggaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44472 - RNA, 1701 nt, Artificial Sequence
  hemagglutinin__InfluenzaA__EPI407123
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugaacugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggaauggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccgguuacggacaaggaccaaaucuuccuguaugcucaaccaucaggaagaaucacaguaucuaccaaaagaagccaacaagcuguaaucccgaauaucggauuuagacccagaauaaggaauaacccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcggaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucggggaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44473 - RNA, 1701 nt, Artificial Sequence
  hemagglutinin__InfluenzaA__EPI407126
augaagacuaucauugcuuugagcuacauucuaugucugguuuucgcucaaaaacuuccuggaaaugacaauagcacggcaacgcugugccuugggcaccaugcaguaccaaacggaacgauagugaaaacaaucacgaaugaccgaauugaaguuacuaaugcuacugaacugguucagaauuccucaauaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggaauggagucacucaaaacggaacaaguucugcuugcauaaggagaucuaauaauaguuucuuuaguagauuaaauugguugacccacuuaaacuucaaauacccagcauugaacgugacuaugccaaacaaugaacaauuugacaaauuguacauuugggggguucaccacccgguuacggacaaggaccaaaucuuccuguaugcucaaccaucaggaagaaucacaguaucuaccaaaagaagccaacaagcuguaaucccgaauaucggauuuagacccagaauaaggaauaacccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcaaagcacucugaaauuggcaacaggaaugcggaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgauugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 44474 - RNA, 1701 nt, Artificial Sequence
  hemagglutinin__InfluenzaA__EPI562037
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcagcuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccagaucuucccguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 44475 - RNA, 1701 nt, Artificial Sequence
  hemagglutinin__InfluenzaA__EPI562034
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacacauacccagcauugaacgugacuaugccaaacaaugaacaauuugacaaauuguacauuugggggguucaccacccggguacggacaaggaccagaucuuccuguaugcucaaucaucaggaagaaucacaguaucuaccaaaagaagccaacaagcuguaaucccaaauaucggaucuagacccagaauaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 44476 - RNA, 1701 nt, Artificial Sequence
  hemagglutinin__InfluenzaA__EPI653140
augaagacuaucauugcuuugagcuacauucuaugucugguuuucgcucaaaaaauuccuggaaaugacaauagcacggcaacgcugugccuugggcaccaugcaguaccaaacggaacgauagugaaaacaaucacaaaugaccgaauugaaguuacuaaugcuacugaguugguucagaauuccucaauaggugaaauaugcgacaguccucaucagauccuugauggagaaaacugcacacuaauagaugcucuauugggagacccucagugugauggcuuucaaaauaagaaaugggaccuuuuuguugaacgaagcaaagccuacagcagcuguuacccuuaugaugugccggauuaugccucccuuaggucacuaguugccucauccggcacacuggaguuuaacaaugaaagcuucaauuggacuggagucacucaaaacggaacaaguucugcuugcauaaggagaucuaguaguaguuucuuuaguagauuaaauugguugacccacuuaaacuacaaauacccagcauugaacgugacuaugccaaacaaugaacaauuugacaaauuguacauuugggggguucaccacccggguacggacaaggaccagaucuucccguaugcucaaucaucaggaagaaucacaguaucuaccaaaagaagccaacaagcuguaaucccaaauaucggaucuagacccagaauaagggguaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaagucugaaugcaucacuccaaauggaagcauucccaaugacaaaccauuccaaaauguaaacaggaucacauacggggccugucccagauauguuaagcauagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaaucgguugaucgggaaaaccaacgagaaauuccaucagauugaaaaagaauucucagaaguagaaggaagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaauaagaaauggaacuuaugaccacaauguguacagggaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 44477 - RNA, 1707 nt, Artificial Sequence
  hemagglutinin__InfluenzaA__ACR48873/m
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagacacacaaugggaagcucugcgaucuagauggagugaagccucuaauuuugagagauuguaguguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauugggggugagcucagcauguccauaccagggaaaguccuccuuuuucagaaaugugguauggcuuaucgaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaaaccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuagcaugccauuccacaauauacacccucucaccaucggggaaugccccaaauaugugaaaucaaacagauuaguccuugcgacugggcucagaaauagcccucaaagagagagaagaagaaaaaagagaggauuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgauuauugacaaaaugaacacucaguuugaggccguuggaagggaauuuaacaacuuagaaaggagaauagagaauuuaaacaagaagauggaagacggguuccuagaugucuggacuuauaaugcugaacuucuaguucucauggaaaaugagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaacggaacguaugacuacccgcaguauucagaagaagcaagacuaaaaagagaggaaauaaguggaguaaaauuggaaucaauaggaauuuaccaaauauugucaauuuauucuacaguggcgagcucccuagcacuggcaaucaugguagcuggucuauccuuauggaugugcuccaaugggucguuacaaugcagaauuugcauuuaa

SEQ ID NO: 44478 - RNA, 1707 nt, Artificial Sequence
  hemagglutinin__InfluenzaA__ACR48874/m
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagacacacaaugggaagcucugcgaucuagauggagugaagccucuaauuuugagagauuguaguguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauugggggugagcucagcauguccauaccagggaaaguccuccuuuuucagaaaugugguauggcuuaucaaaaagaacaguacauacccaacaauaaagaggagcuacaauaauaccaaccaagaagaucuuuugguacugugggggauucaccauccuaaggaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaaaccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuagcaugccauuccacaauauacacccucucaccaucggggaaugccccaaauaugugaaaucaaacagauuaguccuugcgacugggcucagaaauagcccucaaagagagagaagaagaaaaaagagaggauuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgauuauugacaaaaugaacacucaguuugaggccguuggaagggaauuuaacaacuuagaaaggagaauagagaauuuaaacaagaagauggaagacggguuccuagaugucuggacuuauaaugcugaacuucuaguucucauggaaaaugagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaacggaacguaugacuacccgcaguauucagaagaagcaagacuaaaaagagaggaaauaaguggaguaaaauuggaaucaauaggaauuuaccaaauauugucaauuuauucuacaguggcgagcucccuagcacuggcaaucaugguagcuggucuauccuuauggaugugcuccaaugggucguuacaaugcagaauuugcauuuaa

SEQ ID NO: 44479 - RNA, 1701 nt, Artificial Sequence
  hemagglutinin__InfluenzaA__ACD47234
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucuucuugcauaaggggaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuucccguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaaugggagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaggaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 44480 - RNA, 1707 nt, Artificial Sequence
  hemagglutinin__InfluenzaA__ACZ36881
auggagaaaauagugcuucuucuugcaauagucagucuuguuaaaagugaucagauuugcauugguuaccaugcaaacaacucgacagagcagguugacacaauaauggaaaagaacgucacuguuacacacgcacaagacauacuggaaaagacacacaacgggaaacucugcgaucuagauggagugaagccucuaauuuuaagagauuguaguguagcuggauggcuccucgggaacccaaugugugacgaauuccucaaugugccggaauggucuuacauaguggagaagaucaauccagccaaugaccucuguuacccagggaauuucaacgacuaugaagaacugaaacaccuauugagcagaauaaaccauuuugagaaaauucagaucauccccaaaaguucuuggucagaucaugaagccucaucaggggugagcucagcauguccauaccagggaagguccuccuuuuuuagaaaugugguauggcuuaucaaaaaggacaaugcauacccaacaauaaagagaaguuacaauaauaccaaccaagaagaucuuuugguacugugggggauucaccauccaaaugaugcggcagagcagacaaggcucuaucaaaacccaaccaccuauauuuccguugggacaucaacacuaaaccagagacugguaccaaaaauagcuacuagauccaagguaaacgggcaaaguggaaggauggaguucuuuuggacaauuuuaaaaccgaaugaugcaauaaacuuugagaguaauggaaauuucauugcuccagaaaaugcauacaaaauugucaagaaaggggacucaacaauuaugaaaagugaauuggaauaugguaacugcaacaccaagugucaaacuccaauaggggcgauaaacucuaguaugccauuccacaacauccacccucucaccaucggggaaugccccaaauaugugaaaucaaacagauuaguccuugcgacugggcucagaaauagcccucaaggagagagaagaagaagaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuugguaacgguuguuucgaguucuaucauagaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguggcgagcucccuagcacuggcaaucaugguggcuggucuaucuuuauggaugugcuccaauggaucguuacaaugcagaauuugcauuuaa

SEQ ID NO: 44481 - RNA, 1704 nt, Artificial Sequence
  hemagglutinin__InfluenzaA__EPI500771
auggagaaaauaguucuucucuuugcaacaaucagccuugucaaaagcgaucauauuugcauugguuaucaugcaaauaacucgacagagcagguugacacaauaauggaaaagaacguuacuguuacacaugcccaagacauacuggaaaagacacacaacgggaagcucugcgaucuaaauggagugaagccucugauuuuaaaagauuguaguguagcaggauggcuccucggaaauccauugugugacgaauucaccaaugugccagaauggucuuacauaguagagaaggccaauccagccaaugaccucuguuacccagggaauuucaacgauuaugaggaacuaaaacaccuauugagcaggauaaaccauuuugagaaaauacagaucauccccaaagauucuuggucagaucaugaagccucauugggggugagcgcagcauguucauaccagggaaauuccuccuucuucagaaaugugguguggcuuaucaaaaaggacaaugcauacccaacaauaaagaaaggcuacaauaauaccaaccgagaagaucucuugauacugugggggauccaccauccuaaugaugaagcagagcagacaaagcucuaucaaaacccaacuaccuauauuuccauugggacuucaacacuaaaccagagauugguaccaaaaauagccacuagauccaaaauaaacaggcaaaguggcaggauagauuucuucuggacaauuuuaaaaccgaaugacgcaauccauuucgagaguaauggaaauuucauugcuccagaauaugcauacaaaauugucaagaagggagacuccacaaucaugagaagugagguggaauaugguaacugcaacaccaggugucagacuccaauaggggcgauaaacucuagcaugccauuccacaacauacacccucucacuaucggagaaugucccaaauaugugaaaucaaacaaauuaguccuugcaacugggcucagaaauaguccucaaagagagagaagaagaaaaagaggacuguuuggagcuauagcagguuuuauagagggaggauggcagggaaugguagaugguugguauggguaccaccacagcaaugaacagggaagugguuacgcugcagacaaagaaucuacucaaaaggcgauagacggaguaaccaauaaggucaauucgaucauugauaaaaugaacacucaguuugaggcuguaggaagggaauuuaauaacuuggagaggagaauagaaaauuuaaacaagaagauggaagacggauuccuagaugucuggacuuauaaugcugaacuucugguucucauggagaaugagagaacucuagacuuccaugacucaaaugucaagaaccuuuacgauaagguccgacuacagcuuaaggauaaugcaaaagagcugggaaacgguuguuucgaguucuaucacaaauguaauaaugaauguauggaaaguguaagaaacgggacguaugacuacccgcaguauucagaagaagcaagauuaaaaagagaggaaauaaguggaguaaaacuggaaucaauaggaaucuaccaaauacugucaauuuauucaacaguggcgaguucccuagugcuggcaaucaugauggcuggucuaucuuuauggauguguuccaacgggucguuacagugcagaauuugcauuuaa

SEQ ID NO: 44482 - RNA, 1695 nt, Artificial Sequence
  hemagglutinin__InfluenzaA__ABF93441
auggagaaaauagugcuucuucuugcaauagucagucuuguuaaaagugaucagauuugcauugguuaccaugcaaacaacucgacagagcagguugacacaauaauggaaaagaacgucacuguuacacacgcccaagacauacuggaaaagacacacaacgggaagcucugcgaucuagauggagugaagccucuaauuuuaagagauuguaguguagcuggauggcuccucgggaacccaaugugugacgaauuccucaaugugccggaauggucuuacauaguggagaagaucaauccagccaaugaccucuguuacccagggaauuucaacgacuaugaagaacugaaacaccuauugagcagaauaaaccauuuugagaaaauucagaucauccccaaaaguucuuggucagaucaugaagccucaucaggggugagcucagcauguccauaccagggaagguccuccuuuuuuagaaaugugguauggcuuaucaaaaagaacaaugcauacccaacaauaaagagaaguuacaauaauaccaaccaagaagaucuuuugguacugugggggauucaccauccaaaugaugcggcagagcagacaaggcucuaucaaaacccaaccaccuauauuuccguugggacaucaacacuaaaccagagauugguaccaaaaauagcuacuagauccaagguaaacgggcaaaguggaaggauggaguucuuuuggacaauuuuaaaaccgaaugaugcaauaaacuuugagaguaauggaaauuucauugcuccagaaaaugcauacaaaauugucaagaaaggggacucaacaauuaugaaaagugaauuggaauaugguaacugcaacaccaagugucaaacuccaauaggggcgauaaacucuaguaugccauuccacaacauccacccucucaccaucggggaaugccccaaauaugugaaaucaaacagauuaguccuugcgacugggcucagaaauagcccucaaauugaaacuagaggauuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguggcgagcucccuagcacuggcaaucaugguggcuggucuaucuuuguggaugugcuccaauggaucguuacaaugcagaauuugcauuuaa

SEQ ID NO: 44483 - RNA, 1707 nt, Artificial Sequence
  hemagglutinin__InfluenzaA__AGG12577
auggaaaaaauagugcuucuuuuugcaauaaucagccuuguuaaaagcgaucauauuugcauugguuaccaugcaaacaacucgacagagcagguugacacaauaauggaaaagaacguuacuguuacacaugcucaagacauacuggagaagacacacaaugggaagcucugcgaucuaaauggagugaagccucugauuuuaaaagauuguaguguagcaggauggcuccucgggaacccgaugugugacgaauucaucgaugugccagaauggucuuacauaguagagaaggccaauccagccaaugaccucuguuacccagggaauuucaacgauuaugaagaauuaaaacaccuauugagcagaauaaaccauuuugagaaaauacggaucauccccaaagauucuuggccagaucaugaagccucauugggggugagcgcagcauguucauaccagggaaauuccuccuuuuucagaaaugugguauggcuucucaaaaaggacaaugcauacccaauaauaaagaaaagcuacaauaauaccaauaaagaagaucucuugguacugugggggauccaccauccuaaugaugaggcagagcagacaaggcucuaucaaaacccaaccaccuauguuuccauugggacaucaacacuaaaccagagauugguaccaagaauagcuacuagauccaaaguaaacgggcaaaguggaaggauagauuucuucuggacaauuuuaaaaccgaaugaugcaaucaacuucgagaguaauggaaauuucauugcuccagaauaugcauacaaaauagucaagaaaggagacucaacaauuaugagaagugaaguggaauaugguaacugcagcaccaggugucagacuccgaugggggcaauaaauucuaguaugccauuccacaacauacacccucucaccaucggagaaugucccaaauaugugaaaucaaacaaauuaguccuugcgacugggcucagaaauaguccucaaauagaaagaagaagaagaaaaagaggacuguuuggagcuauagcagguuuuauagagggaggauggcagggaaugguagaugguugguauggguaccaccacagcaaugagcaggggaguggauaugcugcagacaaagaauccacucaaaaggcaauagauggggucaccaauaaagucaacucgaucauugacaaaaugaacacucaguuugaggcaguaggaagggaauuuaauaacuuagagaggagaauagagaauuuaaacaagaagauggaagacggauuccuagaugucuggacuuauaaugcugaacuccugguucuaauggaaaaugagagaacucuagacuuccaugacucaaaugucaagaaccuuuacgacaaggucagacuacagcuuagggauaaugcaaaagagcuggguaacgguuguuucgaguucuaucacaaaugugauaaugaauguauggaaaguguaagaaacggaacguaugacuacccgcaguauucagaagaagcaagauuaaaaagagaggaaauaaguggaguaaaauuggaaucaauaggaacuuaccaaauauugucaauuuauucaacaguggcgaguucccuaguacuggcaaucaugguggcuggucuaucuuuauggauguguuccaacgggucguuacaaugcagaauuugcauuuaa

SEQ ID NO: 44484 - RNA, 1707 nt, Artificial Sequence
  hemagglutinin__InfluenzaA__AGC13463
auggaaaaaauagugcuucuuuuugcaauaaucagccuuguuaaaagcgaucauauuugcauugguuaccaugcaaacaacucgacagagcagguugacacaauaauggaaaagaacguuacuguuacacaugcucaagacauacuggagaagacacacaaugggaagcucugcgaucuaaauggagugaagccucugauuuuaaaagauuguaguguagcaggauggcuccucgggaacccgaugugugacgaauucaucgaugugccagaauggucuuacauaguagagaaggccaauccagccaaugaccucuguuacccagggaauuucaacgauuaugaagaauuaaaacaccuauugagcagaauaaaccauuuugagaaaauacggaucauccccaaagauucuuggccagaucaugaagccucauugggggugagcgcagcauguucauaccagggaaauuccuccuuuuucagaaaugugguauggcuucucaaaaaggacaaugcauacccaauaauaaagaaaagcuacaauaauaccaauaaagaagaucucuugguacugugggggauccaccauccuaaugaugaggcagagcagacaaggcucuaucaaaacccaaccaccuauguuuccauugggacaucaacacuaaaccagagauugguaccaagaauagcuacuagauccaaaguaaacgggcaaaguggaaggauagauuucuucuggacaauuuuaaaaccgaaugaugcaaucaacuucgagaguaauggaaauuucauugcuccagaauaugcauacaaaauagucaagaaaggagacucaacaauuaugagaagugaaguggaauaugguaacugcagcaccaggugucagacuccgaugggggcgauaaauucuaguaugccauuccacaacauacacccucucaccaucggagaaugucccaaauaugugaaaucaaacaaauuaguccuugcgacugggcucagaaauaguccucaaauagaaagaagaagaaggaaaagggggcuguuuggagcuauagcagguuuuauagagggaggauggcagggaaugguagaugguugguauggguaccaccacagcaaugagcaggggaguggauaugcugcagacaaagaauccacucaaaaggcaauagauggggucaccaauaaagucaacucgaucauugacaaaaugaacacucaguuugaggcaguaggaagggaauuuaauaacuuagagaggagaauagagaauuuaaacaagaagauggaagacggauuccuagaugucuggacuuauaaugcugaacuccugguucuaauggaaaaugagagaacucuagacuuccaugacucaaaugucaagaaccuuuacgacaaggucagacuacagcuuagggauaaugcaaaagagcuggguaacgguuguuucgaguucuaucacaaaugugauaaugaauguauggaaaguguaagaaacggaacguaugacuacccgcaguauucagaagaagcaagauuaaaaagagaggaaauaaguggaguaaaauuggaaucaauaggaacuuaccaaauauugucaauuuauucaacaguggcgaguucccuaguacuggcaaucaugguggcuggucuaucuuuauggauguguuccaacgggucguuacaaugcagaauuugcauuuaa

SEQ ID NO: 44485 - RNA, 1707 nt, Artificial Sequence
  hemagglutinin__InfluenzaA__ACI06178/m1
auggagaaaauagugcuucuuuuugcgauagucagucuuguuaaaagugaucagauuugcauugguuaccaugcaaacaacucgacagagcagguugacacaauaauggaaaagaacguuacuguuacacaugcccaagacauacuggaaaagacacauaacgggaagcucugugaucuagauggagugaagccucuaaucuugagagauuguaguguagcuggauggcuccucggaaacccaaugugugacgaauucaucaaugugccggaauggucuuauauaguggagaaggccaauccagucaaugaccucuguuacccaggggauuucaaugacuaugaagaauugaaacaccuauugagcagaauaaaccauuuugagaaaauucagaucauucccaaaaguucuuggcccagucaugaagccucauugggggugagcgcagcauguccauaccaggggaaguccucuuuuuucagaaaugugguauggcuuaucaaaaagaacaacacauacccaacaauaaagaggagcuacaauaauaccaaccaagaagaucuuuugguaaugugggggauccaccauccuaaugaugcggcagagcagacaaaucucuaucaaaauccaaccaccuauauuuccguugggacaucaacacuaaaccagagauugacaccaagaauagcuacuagauccaaaguaaacgggcaaagugggaggauggaguucuucuggacaauuuuaaaaccgaaugaugcaaucaacuucgagaguaauggaaacuucauugcuccagaguaugcauacaaaauugucaagaaaggggacucaacaauuaugaaaagugaauuagaauaugguaacugcaacaccaagugucaaacuccaaugggggcgauaaacucuaguaugccauuccacaauauacauccucucaccauuggggaaugccccaaauaugugaaaucaaacagauuaguccuugcgacugggcucagaaauagcccucaaagagagggaagaagaaaaaagagaggauuauuuggagcuauagcagguuucauagagggaggauggcagggaaugguagaugguugguauggguaccaccauagcaaugagcaggggaguggguacgcugcagacaaagaauccacucaaaaggcuauagauggagucaccaauaaggucaacucgaucauugacaaaaugaacacucaguuugaggccguuggaagggaauuuaacaacuuagaaaggagaauagagaauuuaaacaagaagauggaagacggguuccuggaugucuggacuuauaaugcugaacuucugguucucauggaaaaugagagaacucuggacuuccaugacucaaauguaaagaaccuuuacgacaagguccgauuacagcuuagggauaaugcaaaggagcuggguaacgguuguuucgaguucuaucacaaaugugauaaugaauguauggaaagugugagaaacgggacguaugacuauccgcaguauucagaagaagcaagauuaaaaagagaggaaauaaguggagugaaauuggaaucaauaggaauuuaccaaauacugucaauuuauucuacaguggcgaguucucuagcacuggcaaucaugguagcuggucuauccuuguggaugugcuccaauggaucguuacaaugcagaauuugcauuuaa

SEQ ID NO: 44486 - RNA, 1707 nt, Artificial Sequence
  hemagglutinin__InfluenzaA__AHF20402
auggagaaaauagugcuucuuuuugcgauagucagucuuguuaaaagugaccagauuugcauuggcuaccaugcaaacaacucgacagagcagguugacacgauaauggaaaagaacguuacuguuacacaugcccaagacauacuagaaaagacacauaacggaaagcucugugacuuagauggaguuaggccucuaauuuugagagauuguaguguagcuggauggcuucucggaaacccaaugugugacgaauucaucaaugugccagaauggucuuauauaguggagaaggccaauccagucaaugaccucugcuacccaggaguuuucaaugacuaugaagaauugaaacaccuauugagcagaauaaaccauuuugagaaaauucagaucauccccaagaauucuuggcccagucaugaagccucauugggggugagcgcagcauguccauaccaggggcaguccucuuuuuuccgaaaugugguguggcuuaucaaaaagaacaauacauacccaacaauaaagaggaguuacaauaauaccaaccaagaagaucuuuugguaaugugggggauccaccauccuaaugaugcaguagaacagacaaaacucuaucaaaauccaaccaccuauaucuccguugggacgucaacauuaaaccagagauugacaccaagaauagcuacuagauccaaaguaaaaggacuaagugggaggauggaguucuuuuggacaaucuuaaaaccgaaugaugcaaucaacuucgagaguaauggaaauuucaucgcuccagaauaugcauacaaaauugucaagaaaggggacucaacaauuaugagaagugaacuggaauaugguaacugcaacaccaagugucaaacuccaaugggggcgauaaacucuaguaugccauuccacaauauacauccucucacuauuggagaaugccccaaauaugugaaaucaaccagauuaguccuugcgacugggcucagaaauagcccucaaagagaggaaagaagaaaaaagagaggauuauuuggagcuauagcaggguuuauagaaggaggauggcaggggaugguagaugguugguauggguaccaucauagcaacgagcagggaagcggguacgcugcagacaaagaauccacucaaaaggcuauagauggagucaccaauaaggucaacucgaucauugacaaaaugaacacucaguuugaggcuguugggagggaauuuaacaacuuagaaagaagaauagagaauuuaaacaagaagauggaagacggguuccuagauguuuggacuuauaaugcugaacuucugguucucauggaaaaugagagaacucuagacuuccaugacucaaauguaaagaaccuuuacgacaagguccgauuacagcuuagggauaaugccaaggagcuggguaacgguuguuuugaguucuaucacaaaugugauaauaaauguauggaaagugugagaaaugggacauaugacuauccgcaguauucagaagaagcaagauuaaaaagagaggagauaaguggagugaaauuggaaucgauaggaguuuaccaaauacugucaauuuauucuacaguggcgaguucccuagcacuggcaaucaugguagcuggucuauccuuauggaugugcuccaaugggucguuacaaugcagaauuugcauuuaa

SEQ ID NO: 44487 - RNA, 1707 nt, Artificial Sequence
  hemagglutinin__InfluenzaA__ABQ45850
auggagaaaauagugcuucuucuugcaauagucagucuuguuaaaagugaucagauuugcauugguuaccaugcaaacaacucgacagagcagguugacacaauaauggaaaagaacgucacuguuacacacgcccaagacauacuggaaaagacacacaacgggaagcucugcgaucuagacggagugaagccucuaauuuuaagagauuguaguguagcuggauggcuccucgggaacccaaugugugacgaauuccucaaugugccggaauggucuuacauaguggagaagaucaauccagccaaugaccucuguuacccagggaauuucaacgacuaugaagaacugaaacaccuauugagcagaauaaaccauuuugagaaaauucagaucauccccaaaaguucuuggucagaucaugaagccucaucaggggugagcucagcauguccauaccagggaagguccuccuuuuuuagaaaugugguauggcuuaucaaaaagaacgaugcauacccaacaauaaagagaaguuacaauaauaccaaccaagaagaucuuuugguacugugggggauucaccauccaaaugaugcggcagagcagacaaggcucuaucaaaacccaaccaccuauauuuccguugggacaucaacacuaaaccagagauugguaccaaaaauagcuacuagauccaagguaaacgggcaaaguggaaggauggaguucuuuuggacaauuuuaaaaccgaaugaugcaauaaacuuugagaguaauggaaauuucauugcuccagaaaaugcauacaaaauugucaagaaaggggacucaacaaucaugaaaagugaauuggaauaugguaacugcaacaccaagugucaaacuccaauaggggcgauaaacucuaguaugccauuccacaacauccacccucucaccaucggggaaugccccaaauaugugaaaucaaacagauuaguccuugcgacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaauuugaggccguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguggcgagcucccuagcacuggcaaucaugguggcuggucuaucuuuauggaugugcuccaauggaucguuacaaugcagaauuugcauuuaa

SEQ ID NO: 44488 - RNA, 1713 nt, Artificial Sequence
  hemagglutinin__InfluenzaA__AKI82373
auggagaaaauagugccucuucuugcaauaaucggucuuguuaaaagugaucagauuugcauugguuaccaugcaaacaacucgacagagcagguugacacaauaauggaaaagaacguuacuguuacacaugcucaagacauacuggagaagacacacaacgggaagcucugcaaccuagauggagugaagccucuaauucuaaaagacuguaguguagcuggauggcuccucgggaacccaaugugugacgaauuucucaaugugucagaauggucuuacauaguggagaaggccaguccagccaauggccucuguuacccaggggauuucaaugacuaugaagaacugaaacaccuauuaaacagaauaacacaucuuaagaaaauuaagaucauccccaaaaguuauugguccaaucaugaagccucaucaggggugagcgcagcauguuccuauaugggggagcccuccuuuuucagaaaugugguauggcuuaucaaaaagaauaauacauacccaccaauaaaggugaacuacaccaauaccaaucaagaagaucuuuugguacugugggggauucaccaucccaauaaugaggcagagcagauacagaucuaucaaaaccuaaucacccauauuucaguuggaacaucaacacuaaaccagagauugauaccaaaaauagcuacuagauccaaagugaacgggcaaaguggaagaauggaguucuucuggacaauuuuaaagccgaaugauucuaucaauuucgauagcaauggaaauuucauugcuccagaauaugccuacauugucaagaaaggggacucggcaauuaugaaaagugaauuggaguaugguaacugcaacaccaagugucaaacuccaaugggggcgauaaauucuaguaugccauuccacaacauacacccucucaccaucggggaaugccccaaauaugugaagucaaacagauuaguccucgcgacuggacucagaaaugccccucaaagagaaagagaggggggaagaagaagaaaaagaggacuauuuggagccauagcaggguuuauagagggaggauggcagggaaugguagaugguugguauggguaccaccauagcaaugagcaggggaguggguacgcugcagacaaagaauccacucaaaaggcaauagauggaaucacuaauaaggucaacucgaucauugacaaaaugaacacucaauuugaggccguuggaagggaauuuaauaacuuagagaggagaauagaaaauuuaaacaaaaagauggaggacggauuccuagaugucuggacuuauaacgcugaacuucugguucucauggaaaaugagagaacucuagacuuucaugacucaaaugucaagaaccuuuacgaaaagguccgacuacagcuuagggauaaugcaaaggagcuggguaacgguuguuucgaguucuaccacaaaugugauaaugaauguauggaaaguguaagaaacggaacguaugacuacucgcaguauucagaagaagcaagacuaagcagagaggaaauaaauggaguaaaauuggaaucaaugguaacuuaccaaauacugucaauuuauucaacaguggcgaguucccuagcauuggcaaucaugguggcuggucuaucuuuauggaugugcuccaauggaucguuacaaugcagaauuugcauuuga

SEQ ID NO: 44489 - RNA, 1713 nt, Artificial Sequence
  hemagglutinin__InfluenzaA__EPI284473
auggagaaaauagugcuucuucuugcaauaaucagccuuguuaaaagugaucagauuugcauugguuaccaugcaaacaacucgacagagcagguugacacaauaauggaaaagaacguuacuguuacacaugcucaagacauacuggagaagacacacaacgggaagcucugcaaccuagauggagugaagccucuaauucuaaaagacuguaguguagcuggauggcuccucgggaacccaaugugugacgaauuucucaaugugucagaauggucuuacauaguggagaaggccaguccagccaauggccucuguuacccaggggauuucaaugacuaugaagaacugaaacaccuauuaaacagaauaacacaucuuaagaaaauuaagaucauccccaaaaguuauugguccaaucaugaagccucaucaggggugagcgcagcauguuccuauaugggggagcccuccuuuuucagaaaugugguauggcuuaucaaaaagaauaauacauacccaccaauaaaggugaacuacaccaauaccaaucaagaagaucuuuugguacugugggggauucaccaucccaauaaugaggcagagcagauacagaucuaucaaaaccuaaucacccauauuucaguuggaacaucaacacuaaaccagagauugauaccaaaaauagcuacuagauccaaagugaacgggcaaaguggaagaauggaguucuucuggacaauuuuaaagccgaaugauucuaucaauuucgauagcaauggaaauuucauugcuccagaauaugccuacauugucaagaaaggggacucggcaauuaugaaaagugaauuggaguaugguaacugcaacaccaagugucaaacuccaaugggggcgauaaauucuaguaugccauuccacaacauacacccucucaccaucggggaaugccccaaauaugugaagucaaacagauuaguccucgcgacuggacucagaaaugccccucaaagagaaagagaggggggaagaagaagaaaaagaggacuauuuggagccauagcaggguuuauagagggaggauggcagggaaugguagaugguugguauggguaccaccauagcaaugagcaggggaguggguacgcugcagacaaagaauccacucaaaaggcaauagauggaaucacuaauaaggucaacucgaucauugacaaaaugaacacucaauuugaggccguuggaagggaauuuaauaacuuagagaggagaauagaaaauuuaaacaaaaagauggaggacggauuccuagaugucuggacuuauaacgcugaacuucugguucucauggaaaaugagagaacucuagacuuucaugacucaaaugucaagaaccuuuacgaaaagguccgacuacagcuuagggauaaugcaaaggagcuggguaacgguuguuucgaguucuaccacaaaugugauaaugaauguauggaaaguguaagaaacggaacguaugacuacucgcaguauucagaagaagcaagacuaagcagagaggaaauaaauggaguaaaauuggaaucaaugguaacuuaccaaauacugucaauuuauucaacaguggcgaguucccuagcauuggcaaucaugguggcuggucuaucuuuauggaugugcuccaauggaucguuacaaugcagaauuugcauuuga

SEQ ID NO: 44490 - RNA, 1710 nt, Artificial Sequence
  hemagglutinin__InfluenzaA__ACO07033
auggagaaaauagugcuucuucuugcaaugaucggucuuguuaaaagugaucagauuugcauugguuaccaugcaaacaacucgacagagcagguugacacaauaauggaaaagaacguuacuguuacacaugcucaagacauacuggagaagacacacaacgggaagcucugcaaccuagauggggugaagccucuaauuuugaaagacuguaguguagcuggauggcuccucgggaacccaaugugugacgaauuucucaaugugucagaauggucuuacauaguggagaaggccaguccagccaauggccucuguuacccaggggauuucaaugacuaugaagaacugaaacaccuauugagcagaauaaaccaucuuaagaaaauuaagaucauccccaaaaguuauugguccaaucaugaagccucaucaggggugagcgcagcauguuccuaucugggagagcccuccuuuuucagaaaugugguauggcuuaucaaaaagaauaauacauacccaccaauaaaggugaacuacaccaauaccaaccaagaagaucuuuugguacugugggggauucaccaucccaaugaugagaaagagcagauaaggaucuaucaaaacccaaacaccucuauuucaguuggaacaucaacacuaaaccagagauugguaccaaaaauagcuacuagacccaaagugaacgggcaaaguggacgaauggaguucuucuggacaauuuuaaagccgaaugauucuaucaauuucgauagcaauggaaauuucauugcuccagaauaugcauacaaaauugccaagaaaggggacucagugauuaugaaaagugaauuggaauaugguaacugcaacaccaagugucaaacuccaaugggggcgauaaauucuaguaugccauuccacaacauacacccucucaccaucggggaaugccccaaauaugugaaaucaaacagauuaguccucgcgacuggacucagaaaugccccccaaagagagggaggaagaaggagaaaaagaggacuauuuggagccauagcaggguuuauagagggaggauggcagggaaugguagaugguugguauggguaccaccauagcaaugagcaggggaguggauacgcugcagacaaagaauccacucaaaaggcaauagauggaaucaccaauaaggucaacucgaucauugacaaaaugaacacucaguuugagaucguuggaagggaauuuaauaacuuagaaaggagaauagaaaauuuaaacaagaagauggaggacggauuccuagaugucuggacuuauaacgcugaacuucugguucucauggagaaugagagaacucuagacuuucaugacucaaaugucaagaaccuuuacgaaaagguccgacuacagcuuagggauaaugcaaaggagcuggguaacgguuguuuugaguucuaccacaaaugugauaaugaauguauggaaaguguaagaaacggaacguaugacuacccgcaguauucagaagaagcaagacuaagcagagaggaaauaaguggaguaaaaauggaaucaaugguaacuuaucaaauacugucaauuuauucaacaguggcgaguucccuagcauuggcaaucaugguggcuggucuaucuuuauggaugugcuccaauggaucguuacaaugcagaauuugcauuuga

SEQ ID NO: 44491 - RNA, 1695 nt, Artificial Sequence
  hemagglutinin__InfluenzaA__EPI174803
auggagaaaauagugcuucuucuugcaaugaucggucuuguuaaaagugaucagauuugcauugguuaccaugcaaacaacucgacagagcagguugacacaauaauggaaaagaacguuacuguuacacaugcucaagacauacuggagaagacacacaacgggaagcucugcaaccuagauggggugaagccucuaauuuugaaagacuguaguguagcuggauggcuccucgggaacccaaugugugacgaauuucucaaugugucagaauggucuuacauaguggagaaggccaguccagccaauggccucuguuacccaggggauuucaaugacuaugaagaacugaaacaccuauugagcagaauaaaccaucuuaagaaaauuaagaucauccccaaaaguuauugguccaaucaugaagccucaucaggggugagcgcagcauguuccuaucugggagagcccuccuuuuucagaaaugugguauggcuuaucaaaaagaauaauacauacccaccaauaaaggugaacuacaccaauaccaaccaagaagaucuuuugguacugugggggauucaccaucccaaugaugagaaagagcagauaaggaucuaucaaaacccaaacaccucuauuucaguuggaacaucaacacuaaaccagagauugguaccaaaaauagcuacuagacccaaagugaacgggcaaaguggacgaauggaguucuucuggacaauuuuaaagccgaaugauucuaucaauuucgauagcaauggaaauuucauugcuccagaauaugcauacaaaauugccaagaaaggggacucagugauuaugaaaagugaauuggaauaugguaacugcaacaccaagugucaaacuccaaugggggcgauaaauucuaguaugccauuccacaacauacacccucucaccaucggggaaugccccaaauaugugaaaucaaacagauuaguccucgcgacuggacucagaaaugccccccaaacagagacccgaggacuauuuggagccauagcaggguuuauagagggaggauggcagggaaugguagaugguugguauggguaccaccauagcaaugagcaggggaguggauacgcugcagacaaagaauccacucaaaaggcaauagauggaaucaccaauaaggucaacucgaucauugacaaaaugaacacucaguuugagaucguuggaagggaauuuaauaacuuagaaaggagaauagaaaauuuaaacaagaagauggaggacggauuccuagaugucuggacuuauaacgcugaacuucugguucucauggagaaugagagaacucuagacuuucaugacucaaaugucaagaaccuuuacgaaaagguccgacuacagcuuagggauaaugcaaaggagcuggguaacgguuguuuugaguucuaccacaaaugugauaaugaauguauggaaaguguaagaaacggaacguaugacuacccgcaguauucagaagaagcaagacuaagcagagaggaaauaaguggaguaaaaauggaaucaaugguaacuuaucaaauacugucaauuuauucaacaguggcgaguucccuagcauuggcaaucaugguggcuggucuaucuuuauggaugugcuccaauggaucguuacaaugcagaauuugcauuuga

SEQ ID NO: 44492 - RNA, 1704 nt, Artificial Sequence
  hemagglutinin__InfluenzaA__AGZ62382
auggagaaaauagugcuucuuuuugcggcaaucagccuuguuaaaagcgaucauauuugcauugguuaucaugcaaauaacucgacaaagcagguugacacaauaauggaaaagaacguuacuguuacacaugcccaagacauacuggaaaagacacacaaugggaagcucugcgaucuaaauggagugaaaccucugauuuuaaaagauuguaguguagcaggauggcuccucggaaacccaaugugugacgaauucaucaaugugccagaauggucuuacauaguagagaaggccaauccagccaauggccucuguuacccagggaauuucaacgauuaugaggaauugaaacaccuauugagcaggauaaaccauuuugagaaaauacggaucauccccaaagauucuuggucagaucaugaagccucacugggggugagugcagcauguccauaccagggaaauuccuccuucuucagaaaugugguguggcuuaucaaaaaggacaauacauacccaacaauaaagaaaagcuacaauaauaccaaccaagaagaucucuugauacugugggggauucaucacccuaaugaugaagcagagcagacaaggcucuaucaaaacccaaccaccuauauuuccauugggacaucaacacuaaaccagagauugguaccaaaaauagccacuagauccaaaauaaaugggcaaaguggcaggauagauuucuucuggacaauuuuaaaaccgaaugaugcaauccacuucgagaguaacggaaauuucauugcuccagaguaugcauacaaaauugucaagaaaggagacucaacaauuaugaaaagugaaguggaauaugguaauugcaacaccaggugucagacuccuauaggggcgauaaacucuaguaugccauuccacaacauacauccccucaccaucggagaaugucccaaauaugugaaaucaaacaaauuaguccuugcgacugggcucagaaauaguccucaaagagagagaagaagaaaaagaggauuguuuggagcuauagcaggguuuauagagggaggauggcaggggaugguagaugguugguauggguaccaccacagcaacgagcaggggaguggguacgcugcagacaaagaaucuacucaaaaggcaauagacggagucaccaauaaggucaacucgaucauugacaaaaugaacacucaguuugaggccguaggaagggaguuuaauaacuuagagaggagaauagagaauuugaacaagaagauggaagacggauuccuagaugucuggacuuauaaugcagaacuucugguucucauggaaaaugagagaacucuggacuuccaugacucaaaugucaggaaucuuuacgacaaggucagacuacagcuuaaggacaaugcaaaagagcuggguaacgguuguuucgaguucuaccacaaauguaauaaugaauguauggaaaguguaagaaacggaacguaugacuacccgcaguauucagaagaagcaagauuaagaagagaagaaauaaguggaguaaaguuggaaucaauaggaauuuaccaaauauugucaauuuauucaacaguggcaaguuccuuaguacuggcaaucaugauggcuggucuaucuuuauggauguguuccaacgggucguuacagugcagaauuugcauuuaa

SEQ ID NO: 44493 - RNA, 1704 nt, Artificial Sequence
  hemagglutinin__InfluenzaA__ABG67978/m
auggagaaaauagugcuucuucuugcaauagucagccuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucugauuuuaagagauuguaguguagcuggauggcuccucggaaacccaaugugugacgaauucaucaaugugccggaauggucuuacauaguggagaaggccaacccagccaaugaccucuguuacccagggaauuucaacgacuaugaagaacugaaacaccuauugagcagaauaaaccauuuugagaaaauucagaucauccccaaaaguucuugguccgaucaugaagccucaucaggggugagcucagcauguccauaccagggaacgcccuccuuuuucagaaaugugguauggcuuaucaaaaagaauaauacauacccaacaauaaagagaagcuacaauaauaccaaccaggaagaucuuuugauacugugggggauucaucauucuaaugaugcggcagagcagacaaagcucuaucaaaacccaaccaccuauauuuccguugggacaucaacacuaaaccagagauugguaccaaaaauagcuacuagauccaaaguaaacgggcaaaguggaagaauggauuucuucuggacaauuuuaaaaccgaaugaugcaaucaacuucgagaguaauggaaauuucauugcuccagaauaugcauacaaaauugucaagaaaggggacucagcaauuauaaaaagugaaguggaauaugguaacugcaacacaaagugucaaacuccaauaggggcgauaaacucuaguaugccauuccacaacauacacccucucaccaucggggaaugccccaaauaugugaaaucaaacaaauuaguccuugcgacugggcucagaaauaguccucuaagagaaagaagaagaaaaagaggacuauuuggagcuauagcaggguuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagagaauuuaaacaagaaaauggaagacggauuccuagaugucuggacuuauaaugcugaacuucugguucucauggaaaaugagagaacucuagacuuccaugacucaaaugucaagaaccuuuacgacaagguccgacuacagcuuagggauaaugcaaaggagcuggguaacgguuguuucgaguucuaucacaaaugugauaaugaguguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguugcgaguucucuagcacuggcaaucaugguggcuggucuaucuuuguggaugugcuccaaugggucguuacaaugcagaauuugcauuuaa

SEQ ID NO: 44494 - RNA, 1695 nt, Artificial Sequence
  hemagglutinin__InfluenzaA__EPI827075
auggagaaaauaguucuucucuuugcaacaaucagccuugucaaaagcgaucauauuugcauugguuaucaugcaaauaacucgacagagcagguugacacaauaauggaaaagaacguuacuguuacacaugcccaagacauacuggaaaagacacacaacgggaagcucugcgaucuaaauggagugaagccucugauuuuaaaagauuguaguguagcaggauggcuccucggaaauccauugugugacgaauucaccaaugugccagaauggucuuacauaguagagaaggccaauccagccaaugaccucuguuacccagggaauuucaacgauuaugaagaauugaaacaccuauugagcaggauaaaccauuuugagaaaauacagaucauccccaaagauucuuggucagaucaugaagccucauugggggugagugcagcauguucauaccagggaaauuccuccuucuucagaaaugugguguggcuuaucaaaaaggacaaugcauacccaacaauaaagaaaggcuacaauaauaccaaccgagaagaucucuugauacugugggggauccaccauccuaaugaugaggcagagcagacaaggcucuaccaaaacccaacuaccuauauuuccauugggacuucaacacuaaaccagagauugguaccaaaaauagccacuagauccaaaauaaacgggcaaagcggcaggauagauuucuucuggacaauuuuaaaaccgaaugacgcaauccacuucgagaguaauggaaauuucauugcuccagaauaugcauacaaaauugucaagaagggagacuccacaaucaugagaagugaaguggaauaugguaacugcaacaccaggugucagacuccaauaggggcgauaaacucuaguaugccauuccacaacauacacccucucaccaucggagaaugucccaaauaugugaaaucaaacaaauuaguccuugcaacugggcucagaaauaguccucaacgagagacgcgaggacuguuuggagcuauagcagguuuuauagagggaggauggcagggaaugguagaugguugguauggguaccaccacagcaaugaacaggggagugguuacgcugcagacaaagaaucuacucaaaaggcgauagacggagucaccaauaaggucaauucgaucauugacaaaaugaacacucaguuugaggcuguaggaagggaauuuaauaacuuagagaggagaauagaaaauuuaaacaagaagauggaagacggauuccuagaugucuggacuuauaaugcugaacuucugguucucauggagaaugagagaacucuagacuuccaugacucaaaugucaagaaccuuuacgauaagguccgacuacagcuuaaggauaaugcaaaagagcugggaaacgguuguuucgaguucuaucacaaauguaauaaugaauguauggaaaguguaagaaacgggacguaugacuacccgcaguauucagaagaagcaagauuaaaaagagaggaaauaaguggaguaaaacuggaaucaauaggaaucuaccaaauacugucaauuuauucaacaguggcgaguucccuagugcuggcaaucaugauggcuggucuaucuuuauggauguguuccaacgggucguuacagugcagaauuugcauuuaa

SEQ ID NO: 44495 - RNA, 1707 nt, Artificial Sequence
  hemagglutinin__InfluenzaA__ABP96850
auggagaaaauagugcuucuucuugcaauagucagucuuguuaaaagugaucaaauuugcauugguuaccaugcaaacaacucgacagaacagguugacacaauaauggaaaagaacgucacuguuacacacgcccaagacauacuggaaaagacacacaacgggaaacucugcgaucuagauggagugaagccucuaauuuuaagagauuguaguguagcuggauggcuccucgggaacccaaugugugacgaauuccucaaugugccggaauggucuuacauaguggagaagaucaauccagccaaugaccucuguuacccaggggauuucaacgacuaugaagaacugaaacaccuauugagcagaauaaaccauuuugagaaaauucagaucauccccaaaaguucuuggucagauuaugaagccucaucaggagugagcucagcauguccauaccagggaagauccuccuuuuuuagaaaugugguauggcuuaucaaaaagaacaaugcauacccaacaauaaagagaaguuacaauaauaccaaccaagaggaucuuuugguacugugggggauucaccauccgaaugaugcggcagagcagauaaggcucuaucaaaacccaacuaccuauauuuccguugggacaucaacacuaaaccagagauugguaccaaaaauagcuacuagaucuaagguaaaugggcaaaguggaaggauggaguucuuuuggacaauuuuaaaaucgaaugaugcaauaaacuuugagaguaauggaaauuucauugcuccagaauaugcauacaaaauugucaagaaaggggacucaacaauuaugaaaagugaguuggaauaugguaacugcaacaccaaaugucaaacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaagaaagagaggacuauuuggagcuauagcaggguuuauagagggaggauggcagggaaugguagaugguugguauggguaccaccauagcaacgagcaggggaguggguacgcugcagacaaagaauccacucaaaaggcaauagauggagucaccaauaaggucaacucgaucauuaacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaaggucagacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggaaucaauaggaauuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 44496 - RNA, 1692 nt, Artificial Sequence
  hemagglutinin__InfluenzaA__EPI827077
auggagaaaauagugcuucuucuugcaauagucaguauuguuaaaagugaucagauuugcauugguuaccaugcaaacaacucgacagagcagguugacacaauaauggaaaagaaugucacuguuacacacgcccaagacauacuggaaaagacacacaacgggaaacucugcaaucuagauggagugaagccucucauuuugagagauuguaguguagcuggauggcuccucgggaacccaaugugcgaugaauuccucaaugugccggaauggucuuacauaguggagaaaaucaauccagccaaugaccucuguuauccagggaauuucaacgacuaugaagaacugaaacaccuauugagcagaauaaaccauuuugagaaaauucagaucauucccaaagauucuuggucagaucaugaagccucgggagugagcucagcaugcccauaccaaggaagauccuccuuuuuuagaaauguuguauggcuuaccaaaaagaacgaugcauacccaacaauaaagaaaaguuacaauaauacuaaccaagaagaucuuuugguacuaugggggauucaccauccaaaugaugcugcagagcagacaaggcuuuaucaaaacccaacuaccuauaucuccguugggacaucaacacuaaaccagagauugguacccaaaauagcuacuagaucuaagguaaacgggcaaaguggaaggauggaguucuuuuggacaauuuuaaaaucgaaugaugcaauaaacuuugagagcaauggaaacuucauugcuccagaaaaugcauacaaaauugucaagaaaggagauucaacaauuaugaaaagugaguuggaauauaguaacugcaacaccaagugucagacuccaauaggggcgauaaacuccaguaugccauuccacaacauccacccucucaccaucggggaaugccccaaauaugugaaaucaaacagauuaguccuugcuacugggcucaggaauagcccucaacgagagacgcgaggacuauucggagccauagcaggcuuuauagagggaggauggcagggaaugguagaugguugguauggguaccaccauagcaacgagcaggggaguggguacgcugcagacaaagaauccacucaaagggcuauagauggagucaccaauaaggucaauucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaucuuuaugacaagguccgacuacagcuuagggauaaugcaaaggagcuugguaacgguuguuucgaguucuaucacagaugugauaaugaauguauggaaaguguaagaaacggaacguaugacuacccucaauauucagaagaagcaagauuaaaaagagaggaaauaaguggaguaaaauuggagucaauaggaacuuaccaaauacugucaauuuauucaacaguggcgagcucccuagcacuggcaaucaugguggcuggucuaucuuuauggaugugcuccaauggaucgcuacaaugcagaauuugcauuuaa

SEQ ID NO: 44497 - RNA, 1704 nt, Artificial Sequence
  hemagglutinin__InfluenzaA__EPI594523
auggagaaaauaauacuucuucuugcaauaaucggucuuguuaagagugaucagauuugcguuggcuaccaugcaaacaacucgacagagcggguugacacaauaauggaaaagaacguuacuguuacacaugcucaagacauacuggagaagacacacaacgggaagcucugcaaccucaauggagugaagccuuuaauuuuggaagauuguaguguagcuggauggcuccucggaaacccaaugugugacaaauuucucaaugugucagaauggucuuauauaguggagaaggccgguccagccaauggccuuuguuacccaggggauuucaaugauuaugaagaacugaaacaccuauugagcagaauaaaccauuuugaaaaaauugagaucauccccaaaaaucauugguccaaucauaauaccucaggggugagcucagcuuguuccuaucuggagaaucccucuuuuuucagaaauguaguauggcuuaccaaaaagaacaauacauacccaacaauaaaagugaacuacaccaaugccaaccaaaaagaucuuuugguacuguggggaauccaccaucccaauaaugaggcagagcagaaaaugaucuaucaaaacucaaacacuuauguuuccguuggaacaucaacauuaaaccagagacugguacccaaaauagcuacuagauccaaagugaacgggcaaaguggaagaauagacuucuucuggacaauuuuaaagccgaaugauacuaucaauuucgauaguaauggaaauuucauugccccaaaauaugcauacaaaauugucaagaaaggggacucagcaauuaugaaaagugaauugaaauaugauaacugcaacaccaaaugccaaacuccaauaggggcgauaaauucuaguaugccauuccacaacauacauccucucaccaucggggaaugccccaaauaugugaaaucaaacagauuaguccucgcaacuggacucagaaaugccccucaaauagagggaagaagaagaaaaagaggacuauuuggagccauagcaggauuuauagagggaggauggcagggaaugguagauggcugguauggguaccaccauaguaaugagcagggaaguggauacgcugcagacaaggaauccacucaaaaagcaguagauggaaucaccaauaagaucaacucgaucauugacaaaaugaacaaucaguuugaggccguuggaagggaauuuaauaacuuagagaggagaauugaaaauuuaaauaaaaagauggaggacggauuccuagaugucuggacuuauaacgcugaacuucugguucucauggaaaaugagagaacucuagacuuccaugacucaaaugucaagaaucuguaugaaaagguccgacuacagcuuagggauaaugcaaaggagcuggguaacgguugcuucgaguucuaccacaaaugugauaacgaauguauggaaaguguaaaaaacgggacauaugacuacccgcaauauucagaagaagcaagacuaaacagagaggaaauaaguggaguaaaauuggaaucaacuguaacuuaucaaauacugucaauuuauucaacaguggcgaguucccuaguauuggcaaucaugguggcuggucuaucuuuauggaugugcuccaauggaucguuacaaugcagaauuugcauuuga

SEQ ID NO: 44498 - RNA, 1707 nt, Artificial Sequence
  hemagglutinin__InfluenzaA__AAD37782
auggagagaauagugcuucuucuugcaauagucagucuugucaaaagugaucagauuugcauugguuaccaugcaaacaacucgacagagcagguugacacaauaauggaaaagaacguuacuguuacacaugcccaagacauacuggaaaagacacacaaugggaagcucugcgaucuaaauggagugaagccucucauuuugagagauuguaguguagcuggauggcuccucggaaacccuaugugugacgaauucaucaaugugccggaauggucuuacauaguggagaaggccaguccagccaaugaccucuguuacccaggggauuucaacgacuaugaagaacugaaacaccuauugagcagaacaaaccauuuugagaagauucagaucauccccccaaguucuugguccaaucaugaugccucaucaggggugagcucagcauguccauaccaugggagguccuccuuuuucagaaaugugguauggcuuaucaaaaagaacagugcauacccaacaauaaagaggagcuacaauaauaccaaccaagaagaucuuuuaguacugugggggauucaccauccuaaugaugcggcagagcagacaaagcuauaucaaaacccaaccacuuacauuuccguuggaacaucaacacugaaccagagauugguuccagaaauagcuacuagacccaaaguaaacgggcaaaguggaagaauggaguucuucuggacaauuuuaaagccgaaugaugccaucaauuucgagaguaauggaaauuucauugcuccagaauaugcauacaaaauugucaagaaaggggacucagcaauuaugaaaagugaauuggaauaugguaacugcaacaccaagugucaaacuccaaugggggcgauaaacucuaguaugccauuccacaacauacacccccucaccaucggggaaugccccaaauaugugaaaucaaacagauuaguccuugcgacuggacucagaaauaccccucaaagagagagaagaagaaaaaagagaggacuauuuggagcuauagcagguuuuauagagggaggauggcagggaaugguaaaugguugguauggguaccaccauagcaaugagcaggggaguggauacgcugcagacaaagaauccacucaaaaggcaauagauggagucaccaauaaggucaacucgaucauugacaaaaugaacacucaguuugaggccguuggaagggaauuuaauaacuuggaaaggaggauagagaauuuaaacaagcagauggaagacggauuccuagaugucuggacuuauaaugcugaacuucugguucucauggaaaaugagagaacucuagacuuucaugacucaaaugucaagcaccuuuaugacaagguccgacuacagcuuagggauaaugcaaaggagcuggguaaugguuguuucgaguucuaucacaaaugugauaaugaauguauggaaaguguaaaaaacggaacguaugacuacccgcaguauucagaagaagcaagacuaaacagagaggaaauaaguggaguaaaauuggaaucaaugggaacuuaccaaauacugucaauuuauucaacaguggcgaguucccuagcacuggcaaucaugguagcuggucuaucuuuauggaugugcuccaauggaucguuacaaugcagaauuugcauuuaa

SEQ ID NO: 44499 - RNA, 1707 nt, Artificial Sequence
  hemagglutinin__InfluenzaA__AAD51927
auggagaaaauagugcuucuucuugcaauagucagucuugucaaaagugaucagauuugcauugguuaccaugcaaacaacucgacagagcagguugacacaauaauggaaaagaacguuacuguuacacaugcccaagacauacuggaaaagacacacaaugggaagcucugcgaucuaaauggagugaagccucucauuuugagagauuguaguguagcuggauggcuccucggaaacccuaugugugacgaauucaucaaugugccggaauggucuuacauaguggagaaggccaguccagccaaugaccucuguuacccaggggauuucaacgacuaugaagaacugaaacaccuauugagcagaacaaaccauuuugagaaaauucagaucauccccaaaaguucuugguccaaucaugaugccucaucaggggugagcucagcauguccauaccaugggagguccuccuuuuucagaaaugugguauggcuuaucaaaaagaacagugcauacccaacaauaaagaggagcuacaauaauaccaaccaagaagaucuuuuaguacugugggggauucaccauccuaaugaugcggcagagcagacaaagcucuaucaaaacccaaccacuuacauuuccguuggaacaucaacacugaaccagagauugguuccagaaauagcuacuagacccaaaguaaacgggcaaaguggaagaauggaguucuucuggacaauuuuaaagccgaaugaugccaucaauuucgagaguaauggaaauuucauugcuccagaauaugcauacaaaauugucaagaaaggggacucagcaauuaugaaaagugaauuggaauaugguaacugcaacaccaagugucaaacuccaaugggggcgauaaacucuaguaugccauuccacaacauacacccccucaccaucggggaaugccccaaauaugugaaaucaaacagauuaguccuugcgacuggacucagaaauaccccucagagagagagaagaagaaaaaagagaggacuauuuggagcuauagcagguuuuauagagggaggauggcagggaaugguagaugguugguauggguaccaccauagcaaugagcaggggaguggauacgcugcagacaaagaauccacucaaaaggcaauagauggagucaccaauaaggucaacucgaucauugacaaaaugaacacucaguuugaggccguuggaagggaauuuaauaacuuggaaaggaggauagagaauuuaaacaagcagauggaagacggauuccuagaugucuggacuuauaaugcugaacuucugguucucauggaaaaugagagaacucuagacuuucaugacucaaaugucaagaaccuuuaugacaagguccgacuacagcuuagggauaaugcaaaggagcuggguaaugguuguuucgaguucuaucacaaaugugauaaugaauguauggaaaguguaaaaaacggaacguaugacuacccgcaguauucagaagaagcaagacuaaacagagaggaaauaaguggaguaaaauuggaaucaaugggaacuuaccaaauacugucaauuuauucaacaguggcgaguucccuagcacuggcaaucaugguagcuggucuaucuuuauggaugugcuccaauggaucguuacaaugcagaauuugcauuuaa

SEQ ID NO: 44500 - RNA, 1704 nt, Artificial Sequence; identical to SEQ ID NO: 38221
  hemagglutinin__InfluenzaA__AEO89181

SEQ ID NO: 44501 - RNA, 1707 nt, Artificial Sequence; identical to SEQ ID NO: 39675
  hemagglutinin__InfluenzaA__AFM78567

SEQ ID NO: 44502 - RNA, 1707 nt, Artificial Sequence
  hemagglutinin__InfluenzaA__ACR48872
auggagaaaauagugcuucuucuugcaauagucagucuuguuaaaagugaucagauuugcauugguuaccaugcaaacaauucaacagagcagguugacacaaucauggaaaagaacguuacuguuacacaugcccaagacauacuggaaaagacacacaacgggaagcucugcgaucuagauggagugaagccucuaauuuuaagagauuguaguguagcuggauggcuccucgggaacccaaugugugacgaauucaucaauguaccggaauggucuuacauaguggagaaggccaauccaaccaaugaccucuguuacccagggaguuucaacgacuaugaagaacugaaacaccuauugagcagaauaaaccauuuugagaaaauucaaaucauccccaaaaguucuugguccgaucaugaagccucaucaggagugagcucagcauguccauaccugggaagucccuccuuuuuuagaaaugugguauggcuuaucaaaaagaacaguacauacccaacaauaaagaaaagcuacaauaauaccaaccaagaagaucuuuugguacuguggggaauucaccauccuaaugaugcggcagagcagacaaugcuauaucaaaacccaaccaccuauauuuccauugggacaucaacacuaaaccagagauugguaccaaaaauagcuacuagauccaaaguaaacgggcaaaguggaaggauggaguucuucuggacaauuuuaaaaccuaaugaugcaaucaacuucgagaguaauggaaauuucauugcuccagaauaugcauacaaaauugucaagaaaggggacucagcaauuaugaaaagugaauuggaauaugguaacugcaacaccaagugucaaacuccaaugggggcgauaaacucuaguaugccauuccacaacauacacccucucaccaucggggaaugccccaaauaugugaaaucaaacagauuaguccuugcaacagggcucagaaauagcccucaaagagagagcagaagaaaaaagagaggacuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucaaucauugacaaaaugaacacucaguuugaggccguuggaagggaauuuaauaacuuagaaaggagaauagagaauuuaaacaagaagauggaagacggguuucuagaugucuggacuuauaaugccgaacuucugguucucauggaaaaugagagaacucuagacuuucaugacucaaauguuaagaaccucuacgacaagguccgacuacagcuuagggauaaugcaaaggagcuggguaacgguuguuucgaguucuaucacaaaugugauaaugaauguauggaaaguauaagaaacggaacguacaacuauccgcaguauucagaagaagcaagauuaaaaagagaggaaauaagugggguaaaauuggaaucaauaggaacuuaccaaauacugucaauuuauucaacaguggcgaguucccuagcacuggcaaucaugauggcuggucuaucuuuauggaugugcuccaauggaucguuacaaugcagaauuugcauuuaa

SEQ ID NO: 44503 - RNA, 1707 nt, Artificial Sequence
  hemagglutinin__InfluenzaA__ABW06108
auggagaaaauagugcuucuucuugcaauagucagucuuguuaaaagugaucagauuugcauugguuaccaugcaaacaauucaacagagcagguugacacaaucauggaaaagaacguuacuguuacacaugcccaagacauacuggaaaagacacacaacgggaagcucugcgaucuagauggagugaagccucuaauuuuaagagauuguaguguagcuggauggcuccucgggaacccaaugugugacgaauucaucaauguaccggaauggucuuacauaguggagaaggccaauccaaccaaugaccucuguuacccagggaguuucaacgacuaugaagaacugaaacaccuauugagcagaauaaaccauuuugagaaaauucaaaucauccccaaaaguucuugguccgaucaugaagccucaucaggagugagcucagcauguccauaccugggaagucccuccuuuuuuagaaaugugguauggcuuaucaaaaagaacaguacauacccaacaauaaagaaaagcuacaauaauaccaaccaagaagaucuuuugguacuguggggaauucaccauccuaaugaugcggcagagcagacaaggcuauaucaaaacccaaccaccuauauuuccauugggacaucaacacuaaaccagagauugguaccaaaaauagcuacuagauccaaaguaaacgggcaaaguggaaggauggaguucuucuggacaauuuuaaaaccuaaugaugcaaucaacuucgagaguaauggaaauuucauugcuccagaauaugcauacaaaauugucaagaaaggggacucagcaauuaugaaaagugaauuggaauaugguaacugcaacaccaagugucaaacuccaaugggggcgauaaacucuaguaugccauuccacaacauacacccucucaccaucggggaaugccccaaauaugugaaaucaaacagauuaguccuugcaacagggcucagaaauagcccucaaagagagagcagaagaaaaaagagaggacuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucaaucauugacaaaaugaacacucaguuugaggccguuggaagggaauuuaauaacuuagaaaggagaauagagaauuuaaacaagaagauggaagacggguuucuagaugucuggacuuauaaugccgaacuucugguucucauggaaaaugagagaacucuagacuuucaugacucaaauguuaagaaccucuacgacaagguccgacuacagcuuagggauaaugcaaaggagcuggguaacgguuguuucgaguucuaucacaaaugugauaaugaauguauggaaaguauaagaaacggaacguacaacuauccgcaguauucagaagaagcaagauuaaaaagagaggaaauaagugggguaaaauuggaaucaauaggaacuuaccaaauacugucaauuuauucaacaguggcgaguucccuagcacuggcaaucaugauggcuggucuaucuuuauggaugugcuccaauggaucguuacaaugcagaauuugcauuuaa

SEQ ID NO: 44504 - RNA, 1707 nt, Artificial Sequence
  hemagglutinin__InfluenzaA__EPI341633
auggagaaaauaacgcuucuucuuucaauagucagucuuguaaaaagcgaucagauuugcauugguuaccaugcaaacaauucaacggagcagguugacacaaucauggaaaagaacguuacuguuacacaugcccaagacauacuggagaagacacacaacgggaagcucugcgaucuagauggagugaagccucuaauuuuaaaagauugcaguguagcuggauggcuccucgggaauccaaugugugacgaauucaucaauguaccagaguggucuuacauaguggagaaggccaauccaaccaaugaccucuguuacccaggaaguuucaacgacuaugaagaacugaaacaucuauugagcagaauaaaccauuuugagaaaauucagaucauccccaaaaguucuugguccgaucaugaagcaucaucaggagugagcucagcauguccauaccugggaagucccuccuuuuucagaaacgugguauggcuuaucaaaaagaacaguacauacccaacaauaaagaaaaccuacaacaauaccaaccaagaagaucuuuugauacuguggggaauucaccauccuaauaauggggcagagcagacaaugcuauaucaaaacccaaccaccuauauuuccauugggacaucaacacuaaaccagagauugguaccaaaaauagcuacuagauccaaaguaaacgggcaaaguggaagaauggaguuuuuuuggacaauuuuaaaaccaaaugaugcaaucaacuucgagaguaauggaaacuucauugcuccagaauaugcauacaaaauugucaagaaaggggacucagcaauuaugaaaagugaauuggaauaugguaacugcaacaccaagugucaaaccccaaugggagcgauaaacucuaguaugccauuccacaacauacacccuaucaccauuggggaaugccccaaauaugugaaaucaaacagacuagucuuagcaacagggcucagaaacagcccucaaagagagagcagaaggaaaaagagaggucuauuuggagcuauagcagguuuuauagagggaggauggcagggaaugguagaugguugguauggguaccaccauagcaaugagcaggggaguggauacgcugcagacaaagaaucuacucaaaaggcaauagauggagucaccaauaaggucaacucaauuauugacaaaaugaacacucaguuugaggcugucggaagggaauuuaguaacuuagaaaggagaauagagaauuuaaacaagaagauggaagacggguuucuagauguuuggacuuauaaugcagaacuucugguucucauggaaaaugagagaacucuagacuuucaugacucaaaugucaagaaccucuaugacaagguccgacuacagcucagggauaaugcaaaggagcuggguaacgguuguuucgaguucuaucacaaaugugauaaugaauguauggaaaguauaaggaacggaacauacaacuauccgcaauauucagaagaagcaagacuaaaaagagaggaaauaaguggggugaaauuggaaucaauaggaacuuaccaaauacugucaauuuacucaacaguggcgaguucccuagcacuggcaaucaugauagcuggucuaucuuuauggaugugcuccaauggaucgcuacaaugcagaauuugcauuuaa

SEQ ID NO: 44505 - RNA, 1707 nt, Artificial Sequence
  hemagglutinin__InfluenzaA__ABD95991
auggagaaaauaaugcuucuucuugcaauagucagucuuguuaaaagugaucagauuugcauugguuaccaugcaaacaacucgacagagcagguugacacaauaauggaaaagaacgucacuguuacacacgcccaagacauacuggaaaagacacacaacgggaaacucugcgaucuagauggagugaagccucuaauuuuaagagauuguaguguagcuggauggcuccucgggaacccaaugugugacgaauuccucaauguaccggaauggucuuacauaguggagaagaucaauccagccaaugaccucuguuacccagggaauuucaacgacuaugaagaacugaaacaccuauugagcagaauaaaccauuuugagaaaauucagaucauccccaaaaguucuuggucagaucaugaagccucaucaggggugagcucagcauguccauaccagggaagguccuccuuuuuuagaaaugugguauggcuuaucaaaaaggacaaugcauacccaacaauaaagagaaguuacaauaauaccaaccaagaagaucuuuugguacugugggggauucaccauccaaaugaugcggcagagcagacaaggcucuaucaaaacccaaccaccuauauuuccguugggacaucaacauuaaaccagagauugguaccaaaaauagcuacuagauccaagguaaacgggcaaaguggaaggauggaguucuuuuggacaauuuuaaaaccgaaugaugcaauaaacuuugagaguaauggaaauuucauugcuccagaaaaugcauacaaaauugucaagaaaggggacucaacaauuaugaaaagugaauuggaauaugguaacugcaacaccaagugucaaacuccaauaggggcgauaaacucuaguaugccauuccacaacauccacccucucaccaucggggaaugccccaaauaugugaaaucaaacagauuaguucuugcgacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagauaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugauucaaaugucaagaaccuuuacgacaagguccgacuacagcuuagggauaaugcaaaggagcuugguaacgguuguuuugaguucuaucacagaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguggcgagcucccuagcacuggcaaucaugguggcuggucuaucuuuauggaugugcuccaauggaucguuacaaugcagaauuugcauuuaa

SEQ ID NO: 44506 - RNA, 1707 nt, Artificial Sequence
  hemagglutinin__InfluenzaA__AGN69453
auggagaaaauagugcuucuucuugcaauagucagccuuguuaaaagugaucagauuugcauugguuaccaugcaaacaacucgacagagcagguugacacaauaauggaaaagaacgucacuguuacacacgcccaagacauacuggaaaagacacacaacgggaaacucugcgaucuagauggagugaagccucuaauuuuaagagauuguaguguagcuggauggcuccucgggaacccaaugugugacgaauuccucaaugugccggaauggucuuacauaguggagaagaucaauccagccaaugaccucuguuacccagggaauuucaaugacuaugaagaacugaaacaccuauugagcagaauaaaccauuuugagaaaauucagaucauccccaaaaguucuuggucagaucaugaagccucagcaggggugaguucagcauguccauaccagggaauguccuccuuuuuuagaaaugugguauggcuuaucaaaaaggacaaugcauacccaacaauaaagagaaguuacaauaauaccaaccaagaagaucuuuugguauugugggggauucaccauccaaaugaugcggcagagcagacaaagcucuaucaaaacucaacuaccuauauuuccguugggacaucaacacuaaaccagagauugguaccaaaaauagccacuagaucuaagguaaacgggcaaaguggaaggauagaguucuuuuggacaauuuuaaaaccgaaugauacaauaaacuuugagaguaauggaaauuucauugcuccagaaaaugcauacaaaauugucaagaaaggggacucaacaauuaugaaaagugaguuggaauaugguaacugcaacaccaagugucaaacuccaauaggggcgauaaacucuaguaugccauuccacaacauccacccucucaccaucggggaaugccccaaauaugugaaaucaagcagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguggcgagcucccuagcacuggcaaucaugguggcuggucuaucuuuauggaugugcuccaauggaucguuacaaugcagaauuugcauuuaa

SEQ ID NO: 44507 - RNA, 1707 nt, Artificial Sequence
  hemagglutinin__InfluenzaA__AGN69452
auggagaaaauagugcuucuucuugcaauagucagccuuguuaaaagugaucagauuugcauugguuaccaugcaaacaacucgacagagcagguugacacaauaauggaaaagaacgucacuguuacacacgcccaagacauacuggaaaagacacacaacgggaaacucugcgaucuagauggagugaagccucuaauuuuaagagauuguaguguagcuggauggcuccucgggaacccaaugugugacgaauuccucaaugugccggaauggucuuacauaguggagaagaucaauccagccaaugaccucuguuacccagggaauuucaacgacuaugaagaacugaaacaccuauugagcagaauaaaccauuuugagaaaauucagaucauccccaaaaguucuuggucagaucaugaagccucagcaggggugagcucagcauguccauaccagggaagguccuccuuuuuuagaaaugugguauggcuuaucaaaaaggacaaugcauacccaacaauaaagagaaguuacaauaauaccaaccaagaagaucuuuugguauugugggggauucaccauccaaaugaugcggcagagcagacaaggcucuaucaaaacucaacuaccuauauuuccguugggacaucaacacuaaaccagagauugguaccaaaaauagccacuagaucuaagguaaacgggcaaaguggaaggauagaguucuuuuggacaauuuuaaaaccgaaugauacaauaaacuuugagaguaauggaaauuucauugcuccagaaaaugcauacaaaauugucaagaaaggggacucaacaauuaugaaaagugaguuggaauaugguaacugcaacaccaagugucaaacuccaauaggggcgauaaacucuaguaugccauuccacaacauccacccucucaccaucggggaaugccccaaauaugugaaaucaagcagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguggcgagcucccuagcacuggcaaucaugguggcuggucuaucuuuauggaugugcuccaauggaucguuacaaugcagaauuugcauuuaa

SEQ ID NO: 44508 - RNA, 1707 nt, Artificial Sequence
  hemagglutinin__InfluenzaA__ABD73284
auggagaaaauagugcuucuucuugcaauagucagccuuguuaaaagugaucagauuugcauugguuaccaugcaaacaacucgacagagcagguugacacaauaauggaaaagaacgucacuguuacacacgcccaagacauacuggaaaagacacacaacgggaaacucugcgaucuagauggagugaagccucuaauuuuaagagauuguaguguagcuggauggcuccucgggaacccaaugugugacgaauuccucaaugugccggaauggucuuacauaguggagaagaucaauccagccaaugaccucuguuacccagggaauuucaacgacuaugaagaacugaaacaccuauugagcagaauaaaccauuuugagaaaauucagaucauccccaaaaguucuuggucagaucaugaagccucagcaggggugagcucagcauguccauaccagggaagguccuccuuuuuuagaaaugugguauggcuuaucaaaaaggacaaugcauacccaacaauaaagagaaguuacaauaauaccaaccaagaagaucuuuugguauugugggggauucaccauccaaaugaugcggcagagcagacaaggcucuaucaaaacccaacuaccuauauuuccguugggacaucaacacuaaaccagagauugguaccaaaaauagccacuagaucuaagguaaacgggcaaaguggaaggauggaguucuuuuggacaauuuuaaaaccgaaugaugcaauaaacuuugagaguaauggaaauuucauugcuccagaaaaugcauacaaaauugucaagaaaggggacucaacaauuaugaaaagugaguuggaauaugguaacugcaacaccaagugucaaacuccaauaggggcgauaaacucuaguaugccauuccacaacauccacccucucaccaucggggaaugccccaaauaugugaaaucaagcagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguggcgagcucccuagcacuggcaaucaugguggcuggucuaucuuuauggaugugcuccaauggaucguuacaaugcagaauuugcauuuaa

SEQ ID NO: 44509 - RNA, 1695 nt, Artificial Sequence
  hemagglutinin__InfluenzaA__ABF93440
auggagaaaauagugcuucuucuugcaauagucagucuuguuaaaagugaucagauuugcauugguuaccaugcaaacaacucgacagagcagguugacacaauaauggaaaagaacgucacuguuacacacgcgcaagacauacuggaaaagacacacaacgggaaacucugcgaucuagauggagugaagccucuaauuuuaagagauuguaguguagcuggauggcuccucgggaacccaaugugugacgaauuccucaaugugccggaauggucuuacauaguggagaagaucaauccagccaaugaccucuguuacccagggaauuucaacgacuaugaagaacugaaacaccuauugagcagaauaaaccauuuugagaaaauucagaucauccccaaaaguucuuggucagaucaugaagccucaucaggggugagcucagcauguccauaccagggaagguccuccuuuuuuagaaaugugguauggcuuaucaaaaaggacaaugcauacccaacaauaaagagaaguuacaauaauaccaaccaagaagaucuuuugguacugugggggauucaccauccaaaugaugcggcagagcagacaaggcucuaucaaaacccaaccaccuauauuuccguugggacaucaacacuaaaccagagacugguaccaaaaauagcuacuagauccaagguaaacgggcaaaguggaaggauggaguucuuuuggacaauuuuaaaaccgaaugaugcaauaaacuuugagaguaauggaaauuucauugcuccagaaaaugcauacaaaauugucaagaaaggggacucaacaauuaugaaaagugaauuggaauaugguaacugcaacaccaagugucaaacuccaauaggggcgauaaacucuaguaugccauuccacaacauccacccucucaccaucggggaaugccccaaauaugugaaaucaaacagauuaguccuugcgacugggcucagaaauagcccucaaauugaaacuagaggauuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuugguaacgguuguuucgaguucuaucauagaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguggcgagcucccuagcacuggcaaucaugguggcuggucuaucuuuauggaugugcuccaauggaucguuacaaugcagaauuugcauuuaa

SEQ ID NO: 44510 - RNA, 1701 nt, Artificial Sequence
  hemagglutinin__InfluenzaA__AKC45369
auggagaaaauagugcuucuucuugcagugguuagccuuguuaaaagugaucagauuugcauugguuaccaugcaaacaacucgacagagcagguugacacgauaauggaaaaaaacgucacuguuacacaugcccaagacauacuggaaaagacacacaacgggaggcucugcgaucugaauggagugaaaccucugauuuugaaggauuguaguguagcuggauggcuucuuggaaacccaaugugcgacgaguucaucagagugccggaauggucuuacauaguggagagggcuaacccagccaaugaccucuguuacccagggaaccucaaugacuaugaagaacugaaacaccuauugagcagaauaaaucauuuugagaagacucugaucauccccaagaguucuuggcccaaucauacaucaucaggggugagcgcagcauguccauaccagggaacgcccuccuuuuucagaaaugugguauggcuuaccaagaagaacgaugcauacccaacaauaaagaugagcuacaauaauaccaauagggaagaucuuuugauacugugggggauucaucauuccaacaaugcagcagagcagacaaaucucuauaaaaacccaaccaccuauguuuccguugggacaucaacauuaaaccagagauuggugccaaaaauagcuacuagaucccaaguaaacgggcaacguggaagaauggauuucuucuggacaauuuuaaaaccgaaugaugcaauccacuucgagaguaauggaaauuuuauugcuccagaauaugcauacaaaauugucaagaaaggggacucaacaauuaugaaaagugaaauggaauauggccacugcaacaccaaaugucaaacuccaauaggggcgauaaacucuaguaugccauuccacaauauacauccucucacuaucggggagugccccaaauacgugaaaucaaacaaauuaguccuugcgacugggcucagaaauaguccucuaagagaaagaagaagaaaaagaggacuauuuggagcuauagcaggguuuauagagggaggauggcaaggaaugguagaugguugguauggguaccaccauagcaaugaacaggggaguggguacgcugcagacagagaauccacccaaaaggcaauagauggaguuaccaauaaggucaacucgaucauugacaaaaugaacacucaauuugaggccguuggaagggaauuuaauaacuuagaacggagaauagagaauuuaaauaagaaaauggaagacggauuccuagaugucuggacuuauaaugcugaacuucuaguucucauggaaaaugagagaacucuagauuuccaugacucaaaugucaagaaccuuuaugacaaaguccgacugcagcuuagggauaaugcaaaggagcuggguaaugguuguuucgaguucuaucacaaaugugauaaugaauguauggaaaguguaagaaaugggacguaugacuacccccaguauucagaagaagcaagauuaaaaagggaagaaauaagcggagugaaauuggaaucaauaggaacuuaccaaauacugucaauuuauucaacaguggcgaguucccuagcacuggcaaucauuguggcuggucuaucuuuauggaugugcuccaaugggucguuacaaugcagaauuugcauuuaa

SEQ ID NO: 44511 - RNA, 1704 nt, Artificial Sequence; identical to SEQ ID NO: 43462
  hemagglutinin__InfluenzaA__AJS18479

SEQ ID NO: 44512 - RNA, 1704 nt, Artificial Sequence
  hemagglutinin__InfluenzaA__EPI691378
auggagaaaauagugcuucuucuugcagugguuagccuuguuaaaagugaucagauuugcauugguuaccaugcaaacaacucgacagagcagguugacacgauaauggaaaaaaacgucacuguuacacaugcccaagacauacuggaaaagacacacaacgggaggcucugcgaucugaauggagugaaaccucugauuuuaaaggauuguaguguagcuggauggcuucuuggaaacccaaugugcgacgaguucaucagagugccggaauggucuuacauaguggagagggcuaacccagccaaugaccucuguuacccagggaaccucaaugacuaugaagaacugaaacaccuauugagcagaauaaaucauuuugagaagacucugaucauccccaagaguucuuggcccaaucaugaaacaucauuaggggugagcgcagcauguccauaccagggagugcccuccuuuuucagaaaugugguauggcuuaccaagaagaacgaugcauacccaacaauaaagaugagcuacaauaauaccaauagggaagaucuuuugauacugugggggauucaucauuccaacaaugcagcagagcagacaaaucucuauaaaaacccaaccaccuauguuuccguugggacaucaacauuaaaccagagauuggugccaaaaauagcuacuagaucccaaguaaacgggcaacguggaagaauggauuucuucuggacaauuuuaaaaccgaaugaugcaauccacuucgagaguaauggaaauuuuauugcuccagaauaugcauacaaaauagucaagaaaggggacucaacaauuaugaaaagugaaauggaauauggccacugcaacaccaaaugucaaacuccaauaggggcgauaaacucuaguaugccauuccacaauauacacccucucaccaucggggagugccccaaauacgugaaaucaaacaaauuaguccuugcgacugggcucagaaauaguccucuaagagaaagaagaagaaaaagaggacuauuuggagcuauagcaggguucauagagggaggauggcaaggaaugguagaugguugguauggguaccaccauagcaaugaacaggggaguggguacgcugcagacagagaauccacccaaaaggcaauagauggaguuaccaauaaggucaacucgauaauugacaaaaugaacacucaauuugaggccguuggaagggaguuuaauaacuuagaacggagaauagagaauuuaaauaagaaaauggaagacggauuccuagaugucuggacuuacaaugcugaacuuuuaguucucauggaaaaugagagaacucuagauuuccaugauucaaaugucaagaaccuuuaugacaaaguccgacuacagcuuagggauaaugcaaaggagcuggguaaugguuguuucgaguucuaucacaaaugugauaaugaauguauggaaaguguaagaaaugggacguaugacuacccccaguauucagaagaagcaagauuaaaaagggaagaaauaagcggagugaaauuggaaucaauaggaacuuaccaaauacugucaauuuauucaacgguggcgaguucccuagcacuggcaaucauuguggcuggucuaucuuuauggaugugcuccaaugggucguuacaaugcagaauuugcauuuaa

SEQ ID NO: 44513 - RNA, 1704 nt, Artificial Sequence
  hemagglutinin__InfluenzaA__EPI533583
auggagaaaauagugcuucuucuugcaauaguuagccuuguuaaaggugaucagauuugcauugguuaccaugcaaacaacucgacggagcagguugacacgauaauggaaaagaacgucacuguuacacaugcccaagacauacuggaaaagacacacaauggaaagcucugcgauuuaaauggagugaagccucugauuuuaaaggauuguaguguagcuggauggcuucucggaaacccaaugugcgacgaauucaucagggugccggaauggucuuacauaguagaaagggcuaacccagccaaugaccucuguuacccagggaaccucaaugauuaugaagaacugaaacaccuauugagcagaauaaaucauuuugagaaaauucugaucauccccaagaguucuuggaccaaucaugaaacaucauuaggggugagcgcagcaugcccauaccagggaacgcccuccuuuuucagaaaugugguauggcuuaucaaaaagaacgaugcauaccccacaauaaaaauaagcuacaauaauaccaaucaggaagaucuguugauacugugggggguucaccauuccaacaaugcagcagagcagacgaaccucuauaaaaacccaaccaccuauauuuccguugggacaucaacauuaaaccagagauugguaccaaaaauagcuacuagaucccaagugaacggacagcguggaagaauggauuucuucuggacaauucuaaaaccgaaugaugcaauccacuucgagaguaauggaaauuucauugcuccagaauaugcauacaaaauugucaagaaaggggacucaacaauuaugaaaagugaaauggaauauggccacugcaacaccaaaugucaaacuccaauaggggcgauaaacucuaguaugccauuucacaauauacacccucucaccaucggggaaugccccaaauacgugaaaucaaacaaauuaguccuugcgacugggcucagaaauaguccucuaagagaaaagagaagaaaaagaggacuauuuggagcuauagcaggguuuauagagggaggauggcagggaaugguagauggcugguauggguaccaccauagcaaugagcaggggaguggguacgcugcagacaaagaauccacccaaaaggcuauagauggaguuaccaauaaggucaacucgauuauugacaaaaugaacacucaauuugaggccguuggaagggaauuuaauaacuuagaaaggagaauagagaauuuaaacaagaaaauggaagacggauuccuagaugucuggacuuauaaugcugaacuucuaguucucauggaaaaugagagaacucuagauuuccaugacucaaaugucaagaaccuuuacgauaaaguccgacuacagcuuagggacaaugcaaaggaacuggguaaugguuguuuugaguucuaucacaaaugugauaauaaauguauggaaaguguaagaaaugggacauaugacuacccgcaauauucagaagaagcaagauuaaaaagagaagaaauaagcggagugaaauuagagucaauaggaacuuaccaaauacugucaauuuauucaacaguggcgaguucccuagcacuggcaaucauaguggcugguuuaucuuuauggaugugcuccaaugggucguugcagugcagaauuugcauuuaa

SEQ ID NO: 44514 - RNA, 1701 nt, Artificial Sequence
  hemagglutinin__InfluenzaA__AKS48023
auggagaaaauggugcuucuucuugcagugguuagccuuguuaaaagugaucagauuugcauugguuaccaugcaaacaacucgacagagcagguugacacgauaauggaaaaaaacgucacuguuacacaugcccaagacauacuggaaaagacacacaacgggagacucugcgaucugaauggagugaaaccucugauuuuaaaggauuguaguguagcuggauggcuccuuggaaacccaaugugugacgaguucaucagagugccggaauggucuuacauaguggagagggcuaauccagccaaugaccucuguuauccagggaaccucaaugacuaugaggaacugaaacaccuauugagcagaauaaaucauuuugagaagacucugaucauccccaagaguucuuggcccaaucauacaucaucaggggugagugcagcauguccauaccagggaaugcccuccuuuuucagaaaugugguauggcuuaccaaaaagaacgaugcauacccaacaauaaagaugagcuacaauaauaccuauagggaagaucuuuugauacugugggggauucaucauuccaacaaugcagcagagcagacaaaucucuauaaaaacccaaccaccuauguuuccguugggacaucaacauuaaaccagagauuggagccaaaaauagcuacuagaucccaaguaaacgggcaacguggaagaauggauuucuucuggaccauuuuaaaaccgaaugaugcaauccacuucgagaguaauggaaauuuuauugcuccagaauaugcauacaaaauugucaagaaaggggacucaacaauuaugaaaagugaaauggaauaugggcacugcaacaccaaaugucaaacuccaauaggggcgauaaacucuaguaugccauuccacaauauacacccucucacuaucggggagugccccaaauacgugaaaucgaacaaauuaguccuugcgacugggcucagaaauaguccucuaagagaaagaagaagaaaaagaggacuauuuggagcuauagcaggguuuauagagggaggauggcaaggaaugguagaugguugguauggguaccaccauagcaaugaacaggggaguggguacgcugcagacagagaauccacccaaaaggcaauagauggaguuaccaauaaggucaacucgauaauagacaaaaugaacacucaauuugaggccguuggaagagaauuuaauaacuuagaacggagaauagagaauuuaaauaagaaaauggaagacggauucuuagaugucuggacuuauaaugcugaacuuuuaguucucauggaaaaugagagaacucuagauuuccaugacucaaaugucaagaaccuuuaugacaagguccgacuacagcuuagggauaaugcaaaggagcuggguaaugguuguuucgaguucuaucacaaaugugauaaugaauguauggaaaguguaagaaaugggacguaugacuacccccaguauucagaagaagcaagguuaaaaagggaagaaauaagcggggugaaauuggaaucaauaggaacuuaccaaauacugucaauuuauucaacaguggcgaguucccuagcacuggcaaucauuguggcuggucuaucuuuauggaugugcuccaaugggucguuacaaugcagaauuugcauuuaa

SEQ ID NO: 44515 - RNA, 1701 nt, Artificial Sequence
  hemagglutinin__InfluenzaA__EPI587621
auggagaaaauggugcuucuucuugcagcgguuagccuuguuaaaagugaucagauuugcauugguuaccaugcaaacaacucgacagagcagguugacacgauaauggaaaaaaacgucacuguuacacaugcccaagacauacuggaaaagacacacaacgggagacucugcgaucugaauggagugaaaccucugauuuuaaaggauuguaguguagcuggauggcuccuuggaaacccaaugugugacgaguucaucagagugccggaauggucuuacauaguggagagggcuaauccagccaaugaccucuguuauccagggaaccucaaugacuaugaggaacugaaacaccuauugagcagaauaaaucauuuugagaagacuuugaucauccccaagaguucuuggcccaaucauacaucaucaggggugagugcagcauguccauaccagggaaugcccuccuuuuucagaaaugugguauggcuuaccaaaaagaacgaugcauacccaacaauaaagaugagcuacaauaauaccuauagggaagaucuuuugauacugugggggauucaucauuccaacaaugcagcagagcagacaaaucucuauaaaaacccaaccaccuauguuuccguugggacaucaacauuaaaccagagauuggagccaaaaauagcuacuagaucccaaguaaacgggcaacguggaagaauggauuucuucuggaccauuuuaaaaccgaaugaugcaauccacuucgagaguaauggaaauuuuauugcuccagaauaugcauacaaaauugucaagaaaggggacucaacaauuaugaaaagugaaauggaauaugggcacugcaacaccaaaugucaaacuccaauaggggcgauaaacucuaguaugccauuccacaauauacacccucucacuaucggggagugccccaaauacgugaaaucgaacaaauuaguccuugcgacugggcucagaaauaguccucuaagagaaagaagaagaaaaagaggacuauuuggagcuauagcaggguuuauagagggaggauggcaaggaaugguagaugguugguauggguaccaccauagcaaugaacaggggaguggguacgcugcagacagagaauccacccaaaaggcaauagauggaguuaccaauaaggucaacucgauaauagacaaaaugaacacucaauuugaggccguuggaagagaauuuaauaacuuagaacggagaauagagaauuuaaauaagaaaauggaagacggauucuuagaugucuggacuuauaaugcugaacuuuuaguucucauggaaaaugagagaacucuagauuuccaugacucaaaugucaagaaccuuuaugacaagguccgacuacagcuuagggauaaugcaaaggagcuggguaaugguuguuucgaguucuaucacaaaugugauaaugaauguauggaaaguguaagaaaugggacguaugacuacccccaguauucagaagaagcaagguuaaaaagggaagaaauaagcggggugaaauuggaaucaauaggaacuuaccaaauacugucaauuuauucaacaguggcgaguucccuagcacuggcaaucauuguggcuggucuaucuuuauggaugugcuccaaugggucguuacaaugcagaauuugcauuuaa

SEQ ID NO: 44516 - RNA, 1704 nt, Artificial Sequence
  hemagglutinin__InfluenzaA__AJE30333
auggagaaaauagugcuucuucuugcagugauuagccuuguuaaaagugaucagauuugcauugguuaccaugcaaacaacucaacaaagcagguugacacgauaauggagaaaaacgucacuguuacacaugcccaagacauacuggaaaagacacacaacgggaagcucugcgaucuuaauggagugaagccccugauucuaaaggauuguagcguagcuggguggcuccuuggaaauccaaugugcgacgaguucaucaggguaccggaauggucuuacaucguggagagggcuaacccagccaacgaccuauguuacccagggacccucaaugacuaugaggaacugaaacaccuauugagcagaauaaaucauuuugagaaaacucugaucauccccaggaguucuuggcccaaucaugaaacaucauuaggggugagcgcagcauguccauaccagggagcauccucauuuuucagaaaugugguauggcucaucaaaaagaacgaugcauacccgacaauaaagauaagcuacaauaauaccaaucgggaagaucuuuugauacugugggggauucaucauuccaacaaugcagcagagcagacaaaucucuauaaaaacccagacacuuauguuuccguugggacaucaacauuaaaccagagauuggugccaaaaauagcuacuagaucccaaguaaacgggcagaguggaagaauggauuucuucuggacaauuuuaaaaccgaaugaugcaauccacuuugagaguaauggaaauuucauugcuccagaauaugcauacaaaauugucaagaaaggggacucaacaauuaugaaaagugaaauggaguauggccacugcaacaccaaaugucaaacuccaauaggggcgauaaacucuagcaugccauuccacaauauacacccucucaccaucggggaaugccccaaauacgugaagucaaacaaauuaguccuugcgacugggcucagaaauaguccucuaagagaaagaagaagaaaaagaggacuauuuggagcuauagcaggguuuauagagggaggauggcagggaaugguagacgguugguauggguaucaucauagcaaugagcaggggaguggguacgcugcagacaaagaauccacccaaaaggcaauagauggaguuaccaauaaggucaacucaaucauugacaaaaugaacacucaauuugaggccguuggaagggaauuuaauaacuuagaaaggagaauagagaauuuaaacaagaaaauggaagacggauuccuagaugucuggacuuauaaugcugaacuuuuaguucucauggaaaaugagagaacucuagauuuucaugacucaaaugucaagaaccuuuacgacaaaguccgacuacagcuuagggauaaugcaaaggagcugggcaaugguuguuucgaguucuaucacaaaugugauaacgaauguauggagagcguaagaaaugggacguaugacuacccuaaguauucagaagaagcaauauuaaaaagagaagaaauaagcggagugaaauuagaaucaauaggaacuuaccagauacugucaauuuauucaacaguggcgaguucccuagcacuggcaaucauaguggcuggucuaucuuuauggaugugcucuaaugggucguuacaaugcagaauuugcaucuaa

SEQ ID NO: 44517 - RNA, 1704 nt, Artificial Sequence
  hemagglutinin__InfluenzaA__EPI459855
augauugcaaucguugugauagcgauauuggcaucggccggaaaaucagacaagaucuguauuggguaccacgccaacaauucaacaacacaaguggauacacuacuugagaagaauguaacugucacacauucaguugaauuacuagagaaucagaaagaaaagagguucugcaaaauuaugaacaaggccccucucgaccuaaaggauugcaccauagaagguuggauacuggggaauccuaagugcgacuuauugcuuggugaucaaaguuggucauacauaguggaaagaccuaaugcucaaaaugggauuuguuacccaggaguucugaaugaauuagaagaacugaaggcauuuauaggaucuggagaaagaguagagagauuugagauguuucccaaaagcacaugggcaggaguagauacuaguagaggggugacaaacgcuuguccaucuuauacuauugauucaucuuucuacagaaaccuuguauggauaguaaaaacugauucagcaacauauccaguaauuaaggggacguacaacaauacuggaacccagccaauccucuauuucugggguguucaucauccucuugacaccacugugcaggauaauuuguaugggucuggugauaaauacguuagaaugggaacugaaagcaugaauuuugccaagaguccggaaauugcagcaagaccugcugugaacggccaaaggagcagaauugauuauuacuggucugucuugagaccaggggaaaccuuaaauguggaguccaauggaaaucuaauugcuccuugguaugccuacaaauuugucagcacaaauaagaagggagcugucuucaagucagauuuaccaaucgagaacugcgaugccacaugccagacaauuacaggaguccuaagaaccaauaaaacauuucagaaugugagcccucuauggauaggagaaugcccuaaauauguaaaaagugaaagucugaggcuugcaacgggauuaagaaauguuccacagauugcaacaagaggaauuuuuggagcuauugcagguuucauugaaggaggauggacuggaaugauagauggaugguaugguuaucaccacgaaaauucucaaggcucaggauaugcagcagacagagaaagcacccaaaaggcuauagacggaauuacaaauaaggucaacuccaucauuaacaaaaugaacacacaauucgaagcuguagaucacgaauucucaaaccuugagagaagaauuggcaaucugaauaagagaauggaagauggguuucuggacguuuggacuuacaaugcugaguuguugguucuucuugaaaaugaaagaacacuagaucugcaugaugcaaaugugaagaaucuauaugaaaaggucaaaucgcagcuaagggacaacgcuaaugaucuaggaaauggguguuuugaauuuuggcauaagugugacaaugaaugcauggagucugucaaaaaugguaccuaugacuaucccaaauaucagaaggagaguaaauuaaacagacaggggauagaaucugugaagcuagagaaucuugguguguaucaaauucuugccaucuauaguacgguaucgagcagucuaguguugguagggcugaucauggcaauaggucuuuggauguguucaaaugguucaaugcaaugcaggauauguauauaa

SEQ ID NO: 44518 - RNA, 1704 nt, Artificial Sequence
  hemagglutinin__InfluenzaA__EPI459855/m1
augauugcaaucguugugauagcgauauuggcaucggccggaaaaucagacaagaucuguauuggguaccacgccaacaauucaacaacacaaguggauacacuacuugagaagaauguaacugucacacauucaguugaauuacuagagaaucagaaagaaaagagguucugcaaaauuaugaacaaggccccucucgaccuaaaggauugcaccauagaagguuggauacuggggaauccuaagugcgacuuauugcuuggugaucaaaguuggucauacauaguggaaagaccuaaugcucaaaaugggauuuguuacccaggaguucugaaugaauuagaagaacugaaggcauuuauaggaucuggagaaagaguagagagauuugagauguuucccaaaagcacaugggcaggaguagauacaaguagaggggugacaaacgcuuguccaucuuauacuauugauucaucuuucuacagaaaccuuguauggauaguaaaaacugauucagcaacauauccaguaauuaaggggacguacaacaauacuggaacccagccaauccucuauuucugggguguucaucauccucuugacaccacugugcaggauaauuuguaugggucuggugauaaauacguuagaaugggaacugaaagcaugaauuuugccaagaguccggaaauugcagcaagaccugcugugaacggccaaaggagcagaauugauuauuacuggucugucuugagaccaggggaaaccuuaaauguggaguccaauggaaaucuaauugcuccuugguaugccuacaaauuugucagcacaaauaagaagggagcugucuucaagucagauuuaccaaucgagaacugcgaugccacaugccagacaauuacaggaguccuaagaaccaauaaaacauuucagaaugugagcccucuauggauaggagaaugcccuaaauauguaaaaagugaaagucugaggcuugcaacgggauuaagaaauguuccacagauugcaacaagaggaauuuuuggagcuauugcagguuucauugaaggaggauggacuggaaugauagauggaugguaugguuaucaccacgaaaauucucaaggcucaggauaugcagcagacagagaaagcacccaaaaggcuauagacggaauuacaaauaaggucaacuccaucauuaacaaaaugaacacacaauucgaagcuguagaucacgaauuuucaaaccuugagagaagaauuggcaaucugaauaagagaauggaagauggguuucuggacguuuggacuuacaaugcugaguuguugguucuucuugaaaaugaaagaacacuagaucugcaugaugcaaaugugaagaaucuauaugaaaaggucaaaucgcagcuaagggacaacgcuaaugaucuaggaaauggguguuuugaauuuuggcauaagugugacaaugaaugcauggagucugucaaaaaugguaccuaugacuaucccaaauaucagaaggagaguaaauuaaacagacaggggauagaaucugugaagcuagagaaucuugguguguaucaaauucuugccaucuauaguacgguaucgagcagucuaguguugguagggcugaucauggcaauaggucuuuggauguguucaaaugguucaaugcaaugcaggauauguauauaa

SEQ ID NO: 44519 - RNA, 1692 nt, Artificial Sequence
  hemagglutinin__InfluenzaA__ACZ36872
augaacacucaaauccugguauuugcccuuguggcagucauccacacaaaugcagacaaaauuugccuuggacaucaugcuguaucaaauggcaccaagguaaacacacucacugagagaggaguagaaguugucaaugcaacagaaacaguggagcggacaaacauccccaaaauuugcucaaaagggaaaagaaccguugaucuuggccaaugcggacuacuggggaccauuaccggaccaccucaaugugaccaauuucuagaauuuucagcugauuuaauaauugagaggcgggacggaaaugauguuuguuacccggggaaauuugugaauggagaggcauugcggcaaauccucagaaaaucaggugggauuaacaaagaaacaaugggauucacauacaguggaauaagaaccaauggaacaacuagugcguguagaagaucaggaucuucauucuaugcagaaaugaaguggcuccugucagauacagacaaugcugcuuucccacaaaugacgaaaucauacaaaaacacaaggagagaaccagcucugauagucuggggaauccaucauucaggaucaaccaccgagcagaccaaacuauauggaaguggaaauaaacugguaacagucggaaguuccaaauaucagcagucuuuugugccgaguccaggaacacgaccacaaguaaauggccaguccggacgaauugauuuucacugguugauacuggauuccaaugacacaguuacuuuuaguuucaauggggcuuucauagcuccagaucgugcuagcuucuugaagggaaaguccaugggaauccaaagcgaugugcagguugaugccaauugcgaaggggaaugcuaccacaguggagggaccauaacaagcaguuugcccuuccaaaacaucaacagcagggcaguuggcaaguguccaagauauguaaaacaggaaagucuauuauuggcaacagggaugaagaauguucccgaacuucccaaaaaaagaagaaaaagaggccuguuuggcgccauagcgggguuuauugaaaaugguugggaaggucuggucgacggaugguacgguuucaggcaucagaaugcacaaggagaaggaacugcagcagacuacaaaagcacccagucggcaauugaucagauaaccggaaaauuaaauagacucauugagaaaacuaaucagcaauuugagcuaauagauaaugaauucacugagguagaaaagcagauuggcaauguaauuaacuggaccagagacuccaucacagaaguauggucuuacaaugcugaacuucucguggcaauggaaaaucagcacacuauugaucuagcugauucagagaugaacaaauuguaugagcgagugaggaaacaauugagggaaaaugcugaggaagauggcacugguuguuuugagauuuuccacaaaugugaugaugauuguauggcuaguauaaggaacaauacuuaugaucacagcaaauacagagaagaagcaaugcaaaauagaauacaaauugacccagucaaauugagugguggcuacaaagaugugauacuuugguuuagcuucggggcgucaugcuuuuuacuucuugccauugcaaugggccuugucuucauaugugugaagaauggaaacaugcggugcacuauuuguauauaa

SEQ ID NO: 44520 - RNA, 1692 nt, Artificial Sequence
  hemagglutinin__InfluenzaA__AGB51388
augaacacucaaauccugguauucgcccuuguggcagucauccacacaaaugcagacaaaauuugccuuggacaucaugcuguaucaaauggcaccaagguaaacacacucacugagagaggaguagaaguugucaaugcaacagaaacaguggagcggacaaacauccccaaaauuugcucaaaagggaaaagaaccguugaucuuggccaaugcggacuacuggggaccauuaccggaccaccucaaugugaccaauuucuagaauuuucagcugauuuaauaaucgagaggcgggacggaaaugauguuuguuacccggggaaauuugugaauggagaggcauugcggcaaauccucagaaaaucaggugggauuaacaaagaaacaaugggauucacauacaguggaauaagaaccaauggaacaacuagugcauguagaagaucaggaucuucauucuaugcagaaaugaaguggcuccugucagauacagacaaugcugcuuucccacaaaugacgaaaucauacaaaaacacaaggagagaaccagcucugauagucuggggaauccaucauucaggaucaaccaccgagcagaccaaacuauauggaaguggaaauaaacugguaacagucggaaguuccaaauaucagcagucuuuugugccgaauccagaaacacgaccacaaguaaauggccaguccggacgaauugauuuucacugguugauacuggauuccaaugacacaguuacuuuuaguuucaauggggcuuucauagcuccagaucgugcuagcuucuugaagggaaaguccaugggaauccaaagcgaugugcagguugaugccaauugcgaaggggaaugcuaccacaguggagggaccauaacaagcaguuugcccuuccaaaacaucaacagcagggcaguuggcaaguguccaagauauguaaaacaggaaagucuauuauuggcaacagggaugaagaauguucccgaacuucccaaaaaaagaagaaaaagaggccuguuuggcgccauagcgggguuuauugaaaaugguugggaaggucuggucgacggaugguacgguuucaggcaucagaaugcacaaggagaaggaacugcagcagacuacaaaagcacccagucggcaauugaucagauaaccggaaaauuaaauagacucauugagaaaacuaaucagcaauuugagcuaauagauaaugaauucacugagguagaaaagcagacuggcaauguaauuaacuggaccagagacuccaucacagaaguauggucuuacaaugcugaacuucucguggcaauggaaaaucagcacacuauugaucuagcugauucagagaugaacaaauuguaugagcgagugaggaaacaauugagggaaaaugcugaggaagauggcacugguuguuuugagauuuuccacaaaugugaugaugauuguauggcuaguauaaggaacaauacuuaugaucacagcaaauacagagaagaagcaaugcaaaauagaauacaaauugacccagucaaauugagugguggcuacaaagaugugauacuuugguuuagcuucggggcgucaugcuuuuuacuucuugccauugcaaugggccuugucuucauaugugugaagaauggaaacaugcggugcacuauuuguauauaa

SEQ ID NO: 44521 - RNA, 1683 nt, Artificial Sequence; identical to SEQ ID NO: 40492
  hemagglutinin__InfluenzaA__EPI439507

SEQ ID NO: 44522 - RNA, 1704 nt, Artificial Sequence
  hemagglutinin__InfluenzaA__EPI164216
auggagaaaauagugcuucuucuugcaauagucagccuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucugauuuuaagagauuguaguguagcuggauggcuccucggaaacccaaugugugacgaauucaucaaugugccggaauggucuuacauaguggagaaggccaacccagccaaugaccucuguuacccagggaauuucaacgacuaugaagaacugaaacaccuauugagcagaauaaaccauuuugagaaaauucagaucauccccaaaaguucuugguccgaucaugaagccucaucaggggugagcucagcauguccauaccagggaacgcccuccuuuuucagaaaugugguauggcuuaucaaaaagaacaauacauacccaacaauaaagagaagcuacaauaauaccaaccaggaagaucuuuugauacugugggggauucaucauucuaaugaugcggcagagcagacaaagcucuaucaaaacccaaccaccuauauuuccguugggacaucaacacuaaaccagagauugguaccaaaaauagcuacuagauccaaaguaaacgggcaaaguggaaggauggauuucuucuggacaauuuuaaaaccgaaugaugcaaucaacuucgagaguaauggaaauuucauugcuccagaauaugcauacaaaauugucaagaaaggggacucagcaauuguuaaaagugaaguggaauaugguaacugcaacacaaagugucaaacuccaauaggggcgauaaacucuaguaugccauuccacaacauacacccucucaccaucggggaaugccccaaauaugugaaaucaaacaaauuaguccuugcgacugggcucagaaauaguccucuaagagaaagaagaagaaaaagaggacuauuuggagcuauagcaggguuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagagaauuuaaacaagaaaauggaagacggauuccuagaugucuggacuuauaaugcugaacuucugguucucauggaaaaugagagaacucuagacuuccaugauucaaaugucaagaaccuuuacgacaagguccgacuacagcuuagggauaaugcaaaggagcuggguaacgguuguuucgaguucuaucacaaaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguugcgaguucucuagcacuggcaaucaugguggcuggucuaucuuuguggaugugcuccaaugggucguuacaaugcagaauuugcauuuaa

SEQ ID NO: 44523 - RNA, 1683 nt, Artificial Sequence; identical to SEQ ID NO: 42856
  hemagglutinin__InfluenzaA__EPI486492

SEQ ID NO: 44524 - RNA, 1683 nt, Artificial Sequence
  hemagglutinin__InfluenzaA__EPI740738
augaacacucaaauccugguauucgcucugauugcgaucauuccaacaaaugcagauaaaaucugccucggacaucaugccgugucaaacgggaccaaaguaaacacauuaacugaaagaggaguggaagucgucaaugcaacugaaacaguggaacgaacaaacaucccuaggaucugcucaaaagggaaacggacaguugaccucggucaauguggacuccuggggacaaucacuggaccaccucaaugugaccaauuccuagaauuuucggccgauuuaauuauugagaggcgagaaggaagugaugucuguuauccugggaaauucgugaaugaagaagcucugaggcaaauucucagagaaucaggcggaauugauaaggaaacaaugggguucacauacaguggaauaagaacuaauggaguaaccagugcauguaagagaucaggaucuucauucuaugcagaaaugaaauggcuccugucaaacacagauaaugcugcauucccgcagaugacuaagucauauaaaaauacaagaaaaagcccagcuauaauaguaugggggauccaucauuccguuucaacugcagagcaaaccaagcuauaugggaguggaaacaaacuggugacaguugggaguucuaauuaucaacaaucuuucguaccgaguccaggagcgagaccacaaguuaauggucuauccggaagaauugacuuucauuggcuaauacuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggugggacaauaauaaguaacuugccauuucagaacauagauagcagggcaguuggaaaauguccgagauauguuaagcaaaggagucugcugcuggcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacagggaaauuaaaccggcuuauagcaaaaaccaaccaacaauuugaguugauagacaaugaauucaaugagguagagaagcaaaucgguaaugugauaaauuggaccagagauucuauaacagaaguguggucauacaaugcugaacucuugauagcaauggagaaccagcauacaauugaucuggcugauucagaaauggacaaacuguaugaacgggugaaaagacagcugagagagaaugcugaagaggauggcacugguugcuuugaaauauuucacaagugugaugaugacuguauggccaguauuagaaacaacaccuaugaucacagaaaauacagggaagaggcaaugcaaaauagaauacagauugacccagucaagcuaagcagcggcuacaaagaugugauacuuugguuuagcuucggggcaucauguuucauacuucuagccauuguaaugggccuugucuucauaugugugaagaauggaaacaugcggugcacuauuuguauauaa

SEQ ID NO: 44525 - RNA, 1683 nt, Artificial Sequence
  hemagglutinin__InfluenzaA__EPI730495
augaacauucaaauccugguauucgcucugauugcgaucauuccaacagaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagaaaaucaggcggaauugacaaggaagcaaugggauucacauacaguggaauaagaacuaauggagcaaccagugcauguaggagaucaggaucuucauucuaugcagaaaugaaauggcuccugucaaacacagauaaugcugcauucccgcaaaugacuaagucauauaaaaauacaagaaaaagcccagcuauaauaguaugggggauccaucauuccguaucaacugcagagcaaaccaagcuauaugggaguggaagcaaacuggugacaguugggaguucuaauuaucaacaaucuuuuguaccgaguccaggagcgagaccacaaguuaaugguuuaucuggaagaauugacuuucauuggcuaauauuaaaucccaaugauacagucacuuucaguuucaauggggcuuucauagcuccagaccgugcaagcuuccugagaggaaaaucuaugggaauccagaguggaguacagguugaugccgauugugaaggggacugcuaucauaguggagggacaauaauaaguaacuugccauuucagaacauagauagcagggcaguuggaaaauguccgagauauguuaaacaaaggagucugcugcuagcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacagggaaauuaaaccggcuuauagaaaaaaccaaccaacaauuugaauugauagacaaugaauucaucgagguagagaaacaaauugguaaugugauaaacuggaccagagauucuauaacagaaguguggucauacaaugcugaacucuugguagcaauggagaaccagcauacaauugaucuggcugauucagaaauggacaaacuguacgaacgagugaaaagacaacugagagagaaugcugaagaagauggcacuggcugcuuugaaauauuucacaagugugaugaugacuguauggccagcauuaggaauaacaccuaugaucacagcaaauacagggaagaggcaaugcagaauagaauacagauugacccagucaaacuaagcagcggcuacaaagaugugauacuuugguuuagcuucggggcaucauguuucauacuuccagccauuguaaugggccuugucuucauguguguaaagaauggaaacaugcggugcacuauuuguauauaa

SEQ ID NO: 44526 - RNA, 1683 nt, Artificial Sequence
  hemagglutinin__InfluenzaA__EPI712926
augaacacucaaauccugguauucgcucugauugcgaucauuccaacaaaugcagauaaaaucugccucggacaucaugccgugucaaacgggaccaaaguaaacacauuaacugaaagaggaguggaagucgucaaugcaacugaaacaguggaacgaacaaacaucccuaggaucugcucaaaagggaaacggacaguugaccucggucaauguggacuccuggggacaaucacuggaccaccucaaugugaccaauuccuagaauuuucggccgauuuaauuauugagaggcgagaaggaagugaugucuguuauccugggaaauucgugaaugaagaagcucugaggcaaauucucagagaaucaggcggaauugacaaggaaacaaugggguucacauacaauggaauaagaauuaauggaguaaccagugcauguaagagaucaggaucuucauucuaugcagaaaugaaauggcuccugucaaacacagauaaugcugcauucccgcagaugacuaagucauauaaaaauacaagaaaaagcccagcuauaauaguaugggggauccaucauuccguuucaacugcagagcaaaccaagcuauaugggaguggaaacaaacuggugacaguugggaguucuaauuaucaacaaucuuucguaccgaguccaggagcgagaccacaaguuaauggucuauccggaagaauugacuuucauuggcuaauacuaaaucccaaugauacagucacuuucaguuucaauggggcuuucauagcuccagaccgugcaagcuuccugagggggaaaucuauaggaauccagaguggaguacagguugaugccaauugugaaggggacugcuaucauaguggugggacaauaauaaguaacuugccauuucagaacauagauagcagggcaguuggaaaauguccgagauauguuaagcaaaggagucugcugcuggcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacagggaaauuaaaccggcuuauagcaaaaaccaaccaacaauuugaguugauagacaaugaauucaaugagguagagaagcaaaucgguaaugugauaaauuggaccagagauucuauaacagaaguguggucauacaaugcugaacucuugauagcaauggagaaccagcauacaauugaucuggcugauucagaaauggacaaacuguaugaacgagugaaaagacagcugagagagaaugcugaagaggauggcacugguugcuuugaaauauuucacaagugugaugaugacuguauggccaguauuagaaacaacaccuaugaucacagaaaauacagggaagaggcaaugcaaaauagaauacagauugacccagucaagcuaagcagcggcuacaaagaugugauacuuugguuuagcuucggggcaucauguuucauacuucuagccauuguaaugggccuugucuucauaugugugaagaauggaaacaugcggugcacuauuuguauauaa

SEQ ID NO: 44527 - RNA, 1683 nt, Artificial Sequence; identical to SEQ ID NO: 40593
  hemagglutinin__InfluenzaA__AGL44438

SEQ ID NO: 44528 - RNA, 1683 nt, Artificial Sequence
  hemagglutinin__InfluenzaA__EPI445996
auggaaacaguaucacugaugacuauacuacuauuaguaacaacaagcaaugcagacaaaaucuguaucggccaccaaucaacaaauucuacagaaacuguggacacgcuaacagaaacuaauguuccugugacacaugccaaagaauugcuccacacagaucacaauggaaugcugugugcaacaaaucuaggacauccccucauccuagauacaugcaacgucgaaggacugauuuacggcaacccuucuugugaccuucuguugggaggaagagaaugguccuacaucgucgaaagaccaucggcagugaauggaacguguuacccugggaauguagaaaacuuagaggaacucagaacacuuuuuaguuccucuaguuccuaccaaaggauccaaauuuucccagauacaaucuggaaugugacuuacacuggaacaagcaaaucauguucagacuccuucuauaggaauaugagauggcugacucaaaagaacggucuuuacccuguucaagaugcccaauucacaaacaaucggggaaaggacauccuuuuuguauggggcauacaucauccacccaccgauacugcacagacgaauuuauacacaagaaccgacacaacaacaagcgugacaacagaaaaucuggauaggacuuucaaaccauuaauagggccaaggccacuuguuaauggucuaauuggaagaauuaacuauuauuggucaguacuaaaaccaggccagacauugcgaguacgauccaaugggaaucuaauugcuccaugguauggacauguucucucaggagagagccaugggagaauccugaagacuaauuugaacagcgguaauugcguaguucaaugucaaacugaaaaggguggcuuaaacaguacgcugccauuccacaauauuaguaaauaugcauucgggaacugccccaaauauauuggagucaaaagucucaaacuagcaaucggucugagaaacgugccugccaaaucaaguagaggacuauuuggagccauagcuggauucauagaaggagguuggccaggacuagucgcugguugguaugguuuccagcauucuaaugaucaagggguugguauagcggcagauaggguuucaacccaaaaggcaguugauaaaauaacauccaaggugaauaauauaguggauaagaugaacaagcaauaugaaauaauugaucaugaauucagugagguugagacuagacucaauaugaucaauaauaaaauugaugaccaaauacaagacguaugggcauauaaugcagaauugcuaguauuacuugaaaaccagaaaacacucgaugagcaugacgcaaaugugaacaaucuguauaacaaagugaaaagggccuugggcucaaaugcgcuggaagauggaaaggguuguuucgagcuauaccauaaaugugaugaccaaugcauggaaacaauuaggaacgggaccuauaauaggagaaaguaccaagaggaaucaagacuggaaaggcagaaaauagaagggauaaagcuggagucugaggggacuuacaaaauccucacuauuuauucgacugucgccucaucucuuguacuugcaaugggguuugcugccuucuuguucugggccaugucuaauggaucaugcaggugcaacauuuguauauaa

SEQ ID NO: 44529 - RNA, 1695 nt, Artificial Sequence
  hemagglutinin__InfluenzaA__EPI433309
auggagaaaauagugcuucuucuugcaauagccagccuuguuaaaagugaucagauuugcauugguuaccaugcaaacaacucgacagagcagguugacacaauaauggaaaagaacguuacugucacacaugcccaagauauacuggaaaagacacacaacgggaagcucugcgaucuagauggagugaagccucuaauuuuaagagauuguaguguagcuggauggcuccucggaaacccaaugugugacaaauucaacgaugugccggaauggucuuacauaguggagaaggccaacccagccaaugaccucuguuacccagggaaucucaacgauuaugaagaacugaaacaccuauugagcagaauaaaccauuuugagaaaauucagacuuuccccaaaagcucuugguccgaucaugaagccucauugggggugagcgcggcauguccauaccagggaaugcccuccuuuuucagaaaugugguauggcuuaucaaaaagaacaauacauacccaacaauaaagaguagcuacaauaauaccaaucaagaagaucuuuugauacugugggggauucaucauucuaaugaugaggcagaacagacaaggcucuaucaaaacucaaacaccuauauuuccguugggacaucaacacuaaaccagagauugguaccaaaaauagcuacuagauccaaaguaaacgggcaaaguggaaggauggauuuuuucuggacaauuuuaaaaccgaaugaugcaaucaacuucgagaguaacggaaauuucauugcuccagaauaugcauacaaaauugucaagaaaggagacucagcaauuaugaaaagugaaguaggauauggugacugcaacaccaagugucaaacuccaauaggggcgauaaacucuaguaugccauuccacaacauacacccucucaccaucggggaaugccccaaauaugugaaaucaaacaaauuaguccuugcgacugggcucagaaauagcccucaaauugaaacuagaggauuauuuggagcuauagcagguuuuauagagggaggauggcagggaaugguagaugguugguauggguaccaccauagcaaugaacaggggaguggguacgcugcagacaaagaauccacucaaaaggcaauagauggagucaccaauaaggucaacucgaucauugacaaaaugaacacucaguuugaggccguugagagggaauuuaauaacuuagaaaggagaauagagaauuugaacaagaaaauggaagacggauuccuagaugucuggacuuauaaugcugaacuucugguucucauggaaaaugagagaacucuagacuuccaugacucaaaugucaagaaccuuuacgacaagguccgacuacagcuuagggauaaugcaaaggagcuggguaacgguuguuuugaguucuaucacaaaugugauaaugaaugcauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguugcaaguucccuagcacuggcaaucaugguggcuggucuaucuuuauggaugugcuccaaugggucguuacagugcagaauuugcauuuaa

SEQ ID NO: 44530 - RNA, 1683 nt, Artificial Sequence
  hemagglutinin__InfluenzaA__EPI470859
auggaagcaauaccacuaauaacuauacuacuaguaguaacagcaagcaaugcagacaaaaucugcaucggcuaccaaucaacaaacuccacagaaaccguagacacgcuaacagaaaacaauguuccugugacacaugccaaagaauugcuccacacagagcacaaugggaugcugugugcaacaaaucugggacguccucuuauucuagacacuugcaccauugaaggacugaucuauggcaacccuucuugugaucuacuguugggaggaagagaaugguccuacaucgucgaaagaccaucggcuguuaauggaauguguuaccccgggaauguagaaaaccuagaggaacuaaggucauuuuuuaguucugcuaguuccuaccaaagaauccagaucuuuccagacacaaucuggaaugugucuuacaguggaacaagcaaagcauguucagauucauucuacaggagcaugagaugguugacucaaaagaacaacgcuuacccuauucaagacgcccaauacacaaauaauagaggaaagagcauucuuuucauguggggcauaaaucacccaccuaccgauacugcacagacaaaucuguacacaaggacugacacaacaacaaguguggcaacagaagauauaaauaggaccuucaaaccagugauagggccaaggccccuugucaauggucugcagggaagaauugauuauuauuggucgguauugaaaccaggucagacauugcgaguaagauccaaugggaaucuaaucgcuccaugguaugggcacauucuuucaggagagagccacggaagaauccugaagacugauuuaaacagugguagcuguguagugcaaugucaaacagaaagagguggcuuaaauacuacuuugccauuccacaaugucaguaaauaugcauuuggaaacugcccaaaauauguuggaguaaagagucucaaacuggcaguuggucugaggaaugugccugcuagaucaaguagaggacuauuuggggccauagcuggauucauagagggagguuggucagggcuggucgcugguugguauggguuccagcauucaaaugaucaagggguugguauagcugcagauagagacucaacucaaagggcaauugacaaaauaacguccaaagugaauaauauagucgauaaaaugaacaagcaauaugaaauuauugaucaugaauucagcgagguugaaaauagacucaauaugaucaauaauaagauugaugaccagauacaagacauaugggcauauaacgcugaauugcuagugcugcuugaaaaccagaaaacacucgaugagcaugaugcgaauguaaacaaucuauauaacaaagugaagagggcacuggguuccaaugcaauggaagaugggaaaggauguuucgagcuauaccauaaaugugaugaucagugcauggagacaauucggaacgggaccuauaacaggaggaaguauaaagaggaaucaagacuagaaagacagaaaauagaaggggucaagcuggaaucugaaggaacuuacaaaauccucaccauuuauucgacugucgccucaucucuugugauugcaaugggguuugcugccuucuuguucugggccauguccaauggaucuugcagaugcaacauuuguauauaa

SEQ ID NO: 44531 - RNA, 1683 nt, Artificial Sequence
  hemagglutinin__InfluenzaA__EPI498037
auggagacaguaucacuaauaacuauacuacuaguagcaacaguaagcaaugcagauaaaaucugcaucggcuaucaaucaacaaacuccacagaaacuguggacacacuaacagaaaacaaugucccugugacacaugccaaagaacugcuccacacagagcauaaugggaugcugugugcaacaagcuugggacaaccucuuauuuuagacaccugcaccauugaagggcuaaucuauggcaauccuucuugugaucuauugcuggaaggaagagaaugguccuauaucgucgagagaccaucagcuguuaacggauuguguuaccccgggaauguagaaaaucuagaagagcuaaggucacuuuuuaguucugcuagaucuuaucaaagaauccagauuuucccagacacaaucuggaaugugucuuacaaugggacaagcaaagcuugcucagguucauucuacagaagcaugagaugguugacucgaaagaacggcgauuaccccauccaagacguccaauacacaaauaaucaagggaagaacauucuuuucauguggggcauaaaucacccacccaccgauacuacgcagagagaucuguacacgagaaccgacacaacaacgaguguggcaacagaagaaauaaauaggaucuucaaaccauugauaggaccaaggccucuugucaacgguuugaugggaagaauugauuauuauuggucgguuuugaaaccgggucaaacacugcgaauaaaaucugaugggaaucuaauagcuccaugguauggacacauucuuucaggagagagccacggaagaauucugaagacugaucuaaaaagggguagcugcacagugcaaugucagacagagaaagguggcuuaaacacaacauugccauuccaaaauguaaguaaguaugcauuuggaaacugcucaaaauacauuggcauaaagagccucaaacuugcaguuggucugaggaaugugccuucuagaucuaguagaggacuauucggggccauagcaggguuuauagagggagguuggucaggacuaguugcugguugguauggguuccagcauucaaaugaccaagggguugguauggcagcagauagagacucaacucaaaaggcaauugauaaaauaacauccaaagugaauaauauagucgacaaaaugaacaagcaauaugaaaucauugaucaugaauucagugagguagaaacuagacuuaacaugaucaauaauaagauugaugaucaaauccaggauauaugggcauauaaugcagaauugcuaguucugcuugaaaaccagaaaacacucgaugagcaugacgcaaauguaaacaaucuauauaauaaaguaaagagggcguuggguuccaaugcgguggaagaugggaaaggauguuucgagcuauaccacaaaugugauaaccaaugcauggagacaauucggaacgggaccuacaacaaaaggaaauaucaagaggagucaaaauuagaaagacagaaaauagagggggucaagcuggaaucugaaggaacuuacaaaauccucaccauuuauucgacugucgccucaucucuugugauugcaaugggguuugcugccuucuuguucugggccauguccaaugggucuugcagaugcaacauuuguauauaa

SEQ ID NO: 44532 - RNA, 1683 nt, Artificial Sequence
  hemagglutinin__InfluenzaA__AGO17847
auggaaacaauaucacuaaugacuauacuacugauaacgacagcaagcaaugcagauaaaaucugcaucggucaccagucaacaaacuccacagaaacuguggacacgcuaacagaaaccaauguuccugugacacaugccaaagaauugcuccaaacagagcacaauggaaugcugugugcgacaaaucuggggcauccccucauucuagacacaugcacuaucgaaggacuaaucuauggcaaccccucuugugaccugcuauuggagggaagagaaugguccuacauagucgaaagacccucagcuguaaacggaacuuguuacccugggaauguagaaaaccuagaggaacucaggacacuuuuuaguuccgccaguuccuaccaaagaauccaaaucuucccagacacaacauggaauguuacuuacacuggaacaagcagaucauguucagguucauucuacaggaguaugagauggcugacucaaaaaagcggguuuuacccuguccaagacgccaaauacacaaauaacagggggaagaacauccuuuucgugugggguauacaucacccacacaccuauaccgaccaaacaacuuuguacauaagaaacgacacaacaacaagugugacaacagaggaguugaauaggaucuucaaaccagugauagugccaaggcuucuugucaauggucagcaggggagaauugauuauuauuggucaguacuaaaaccaggccaaacauugcgaguaagauccaaugggaaucuaauugcuccaugguauggacacguucuuucaggagggagccauggaagaauccugaagacugauuuaaaaaguggcaauuguguagugcaaugucagacugaaaaagguggauuaaacaguacauugcccuuccacaauaucagcaaauaugcauuuggaaccugccccaaauauguaaaagucaauagucucaaacuggcaauuggucugaggaaugugccugcuagaucaaauagaggacuauuuggggcuaucgcugguuucauagaaggagguuggccaggacuaguagcuggcugguaugguuuccagcauucaaaugaucaagggguugguauggccgcagauagggauucaacucaaaaggcaguugauaaaauaacaucuaaggugaauaauauagucgacaagaugaauaagcaauaugaaauaauugaucaugaauucagugagguugaaacuagacucaauaugaucaauaauaagauugaugaucaaauacaagacguaugggcauauaaugcagaauugcuaguacuacuugaaaaccagaaaacgcucgaugagcaugaugcgaacgugaacaaucuauauaacaaggugaagagggcucugggcuccaaugcuauggaagaugggaaagguuguuucgaguuauaccauaagugugaugaucaaugcauggaaacaauucgaaacgggaccuaugauaggagaaaguauagagaggaaucaagauuagaacggcagagaauagaagggguuaaacuggaaucugagggaacuuacaaaauccucacuauuuauucgacugucgccucaucucuugugauugcgaugggguuugcugccuuccuguucugggccauguccaaugguucuugcaggugcaacauuuguauauaa

SEQ ID NO: 44533 - RNA, 1683 nt, Artificial Sequence
  hemagglutinin__InfluenzaA__ANZ03807
auggagacaguaucacuaauaacuauacuacuaguagcaacaguaagcaaugcagauaaaaucugcaucggcuaucaaucaacaaacuccacagaaacuguggacacacuaacagaaaacaaugucccugugacacaugccaaagaacugcuccacacagagcauaaugggaugcugugugcaacaagcuugggacaaccucuuauuuuagacaccugcaccauugaagggcuaaucuauggcaauccuucuugugaucuaucgcuggaaggaagagaaugguccuauaucgucgagagaccaucagcuguuaacggauuguguuaccccgggaauguagaaaaucuagaagagcuaaggucacuuuuuaguucugcuaggucuuaucaaagaauccagauuuucccggacacaauauggaaugugucuuacgauggaacaaguacagcaugcucagguucauucuacagaagcaugagaugguugacucgaaagaacggcgauuacccuacccaagacgcccaauacacaaauaaucaagggaagaacauccuuuucauguggggcauaaaucauccacccaccgaugauacgcagagaaaucuguacacgagaaccgacacaacaacgaguguggcaacagaagaaauaaauaggaucuucaaaccauugauaggaccaaggccucuugucaacgguuugaugggaagaauugauuauuauuggucuguauugaaaccgggucaaacacugcgaauaaaaucugaugggaaucuaauagcuccaugguauggacacauucuuucaggagagagccauggaagaauucugaagacugauuugaaaagggguagcugcacagugcaaugucagacagagaaagguggcuuaaacacaacacugccauuccaaaauguaaguaaguaugcauuuggaaacugcucaaaauacauuggcauaaagagucucaaacuugcaguuggucugaggaaugugccuucuagaucuaguagaggacuauucggggccauagcaggguuuauagagggagguuggucaggacucguugcugguugguauggguuccagcauucaaaugaccaagggguagguauggcagcagauagagacucaacccaaaaggcaauugauaaaauaacauccaaagugaauaauauagucgacaaaaugaacaagcaguaugaaaucauugaucaugaauucagugagguggaaacuagacuuaacaugaucaauaauaagauugaugaucaaauccaggauauaugggcauauaaugcagaauugcuaguuuuacuugaaaaucagaaaacacucgaugagcaugacgcaaaugugaacaaucuauauaauaaaguaaagagggcguuggguuccaaugcgguggaagaugggaaaggauguuucgagcuauaccacaaauguaaugaccaaugcauggagacaauucggaacgggaccuacaacagaaggaaguaucaagaggagucaaaauuagaaagacagaaaauagagggggucaagcuggaaucugaaggaacuuacaaaauccucaccauuuauucgacuguugccucaucucuugugauugcaaugggguuugcugccuucuuguucugggccauguccaaugggucuugcagaugcaacauuuguauauaa

SEQ ID NO: 44534 - RNA, 1683 nt, Artificial Sequence; identical to SEQ ID NO: 44533
  hemagglutinin__InfluenzaA__EPI680526

SEQ ID NO: 44535 - RNA, 1683 nt, Artificial Sequence; identical to SEQ ID NO: 44189
  hemagglutinin__InfluenzaA__ALT20080

SEQ ID NO: 44536 - RNA, 1410 nt, Artificial Sequence
  neuraminidase__InfluenzaA__AAA43084
augaauccaaaucaaaagauaauaacaauuggcucugucucucucaccauugcaacaguaugcuuccucaugcagauugccauccuggcaacuacugugacauugcauuuuaaacaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgacccuggcaaguguuaucaauuugcacucgggcaggggaccacacuagacaacaaacauucaaauggcacaauacaugauagaaucccucaccgaacccuauuaaugaaugaguuggguguuccauuucauuuaggaaccaaacaaguguguguagcaugguccagcucaaguugucacgauggaaaagcaugguugcauguuugugucacuggggaugauagaaaugcgacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacguaagauguaucugcagagacaacuggaaaggcucuaauaggcccguuauagacauaaauauggaagauuauagcauugauuccgguuaugugugcucagggcuuguuggcgacacacccaggaacgacgacagcucuagcaauagcaauugcagggauccuaacaaugaaagagggaauccaggagugaaaggcugggccuuugacaauggagaugauguauggaugggaagaacaaucaacaaagaaucacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 44537 - RNA, 1362 nt, Artificial Sequence
  neuraminidase__InfluenzaA__AAA43397
augaauccaaaccagaaaauaauaaccauugggucaaucuguaugguagucggaauaauuagccuaauauugcaaauaggaaauauaaucucaauauggauuagccauucaauucaaaccggaaaucaaaaccauacuggaauaugcaaccaaggcagcauuaccuauaaaguuguugcugggcaggacucaacuucagugauauuaaccggcaauucaucucuuugucccauccgugggugggcuauacacagcaaagacaauggcauaagaauugguuccaaaggagacguuuuugucauaagagagccuuuuauuucauguucucacuuggaaugcaggaccuuuuuucugacucaaggcgccuuacugaaugacaagcauucaagggggaccuuuaaggacagaagcccuuauagggccuuaaugagcugcccugucggugaagcuccguccccguacaauucaagguuugaaucgguugcuuggucagcaagugcaugucaugauggagugggcuggcuaacaaucggaauuucugguccagaugauggagcaguggcuguauuaaaauacaaccgcauaauaacugaaaccauaaaaaguuggaggaagaauauauugagaacacaagagucugaauguaccuguguaaaugguucauguuuuaccauaaugaccgauggcccaagugaugggcuggccucguacaaaauuuucaagaucgagaaggggaagguuacuaaaucaauagaguugaaugcaccuaauucucacuacgaggaauguuccuguuacccugauaccggcaaagugaugugugugugcagagacaauuggcacgguucgaaccgaccauggguguccuucgaccaaaaccuagauuauaaaauaggauacaucugcagugggguuuucggugacaacccgcgucccaaagauggaacaggcagcuguggcccagugucugcugauggagcaaacggaguaaagggauuuucauauaaguauggcaaugguguuuggauaggaaggacuaaaagugacaguuccagacauggguuugagaugauuugggauccuaauggauggacagagacugauaguagguucucuaugagacaagauguuguggcaauaacuaaucggucaggguacagcggaaguuucguucaacauccugagcuaacagggcuagacuguaugaggccuugcuucuggguugaauuaaucagggggcuaccugaggaggacgcaaucuggacuagugggagcaucauuucuuuuuguggugugaauagugauacuguagauuggucuuggccagacggugcugaguugccguucaccauugacaaguag

SEQ ID NO: 44538 - RNA, 1365 nt, Artificial Sequence
  neuraminidase__InfluenzaA__AAA43412
augaauccaaaucagaaaauaauaaccauuggaucaaucugucugguagucggacuaauuagccuaauauugcaaauagggaauauaaucucaauauggauuagccauucaauucaaacuggaagucaaaaccauacuggaauaugcaaccaaaacaucauuaccuauaaaaauagcaccuggguaaaggacacaacuucagugauauuaaccggcaauucaucucuuugucccauccgugggugggcuauauacagcaaagacaauagcauaagaauugguuccaaaggagacguuuuugucauaagagagcccuuuauuucauguucucacuuggaaugcaggaccuuuuuucugacccaaggugccuuacugaaugacaggcauucaaaugggacuguuaaggacagaagcccuuauagggccuuaaugagcugcccugucggugaagcuccguccccguacaauucaagauuugaaucgguugcuuggucagcaagugcaugucaugauggcaugggcuggcuaacaaucggaauuucagguccagauaauggagcaguggcuguauuaaaauacaacggcauaauaacugaaaccauaaaaaguuggaggaagaaaauauugaggacacaagagucugaaugugccuguguaaaugguucauguuuuacuauaaugacugauggcccgagugaugggcuggccucguacaaaauuuucaagaucgaaaaggggaagguuacuaaaucaauagaguugaaugcaccuaauucucacuaugaggaauguuccuguuacccugauaccggcaaagugaugugugugugcagagacaauuggcaugguucgaaccggccaugggugucuuucgaucaaaaccuggauuaucaaauaggauacaucugcagugggguuuucggugacaacccgcgucccaaagauggaacaggcagcugugguccaguguauguugauggagcaaacggaguaaagggauuuucauauagguaugguaaugguguuuggauaggaaggaccaaaagucacaguuccagacauggguuugagaugauuugggauccuaauggauggacagagacugauaguaaguucucugugaggcaagauguuguggcaaugacugauuggucaggguauagcgggaguuucguucaacauccugagcuaacagggcuagacuguauaaggccgugcuucuggguugaauuaaucaggggacgaccuaaagaaaaaacaaucuggacuagugcgagcagcauuucuuuuuguggcgugaauagugauacuguagauuggucuuggccagacggugcugaguugccauucaccauugacaaguag

SEQ ID NO: 44539 - RNA, 1410 nt, Artificial Sequence
  neuraminidase__InfluenzaA__AAG01743
augaauccaaaucaaaagauaauaacacuuggcucugucucucucaccauugcaacaauaugcuuccucaugcagauugccauccugguaaccacuguaacauugcauuucaagcaauaugagugcgacuacccagcgaacaaccaagcaaugccgugugaaccaauaauaauagaaaggaacauaacagagauaguguaucugacuaacaccaccauagaaaaagagguaugccccaaauuaguggaauacaggaauuggucaaaaccacaauguaaaauuacaggauuugcaccuuucucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucacuugggaaccaggcaaguguguauagcaugguccagcucaaguugucacgauggaaaagcauggcugcauguuugugucacuggguaugauaaaaaugcaacugcuagcuucauuuacgaugggaggcuuguagacagcauugguucauggucucaaaauauccucaggacccaggagucggaauguguuugcaucaaugggacuuguacagugguaaugacugauggaagugcuucaggaagagcugauaccaaaauacuauucauugaagaggggaaaauuguucauacuagcccauugucaggaagugcucagcauguagaggaguguuccuguuauccucgauauccuggugucagauguaucugcagagacaacuggaaaggcucuaauaggccagucguagauauaaaugugaaagauuauagcauuaauuccaguuaugugugcucagggcuugugggcgacacacccagaaacaaugacagaucuagcaguagcuauugccagaauccuaacaaugaaaaagggacucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaauaucaugccuauauaa

SEQ ID NO: 44540 - RNA, 1410 nt, Artificial Sequence
  neuraminidase__InfluenzaA__AAG01759
augaauccaaaucaaaagauaauaacgauuggcucuguuucucucacuauugccacaaugugcuuccuuaugcaaauugccauccugguaacuacuguaacauugcauuucaagcaauaugaaugcaacucccccccaaacaaccaaguaauacugugugaaccaacaauaauagaaagaaacauaacagagauaguguaucugaccaacaccaccauagagaaggaaauaugccccaaacuagcagaauacaaaaauuggucaaagccgcaauguaaaauuacaggauuugcaccguuuuccaaggacaauucgauuaggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauauuauucauugaggaggggaaaaucguucauauuagcccauuguuaggaagugcucagcaugucgaggagugcuccuguuauccucgauauccuggugucagaugugucugcagagacaacuggaaaggcuccaauaggcccaucguagauauaaauguaaaggauuauagcauuguuuccagcuaugugugcucaggacuuguuggagacacacccagaaaaaacgacagauccagcaguagcaauugccugaauccuaacaaugaggaagggggucauggagugaaaggcugggccuuugaugauggaaaugacguguggaugggaagaacgaucagcgagaaauuacgcucagguuaugaaaccuucaaagucauugaagguugguccaaaccuaacuccaaauugcagauaaauaggcaagucauaguugacagagguaauagguccgguuauucuggcauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44541 - RNA, 1410 nt, Artificial Sequence
  neuraminidase__InfluenzaA__AAG01777
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaauacugugugaaccaacaauaauagaaagaaacauaacagagauaguguaucugaccaacaccaccauagagaaggaaauaugccccaaacuagcagaauacaaaaauuggucaaagccgcaauguaaaauuacaggauuugcaccguuuuccaaggacaauucgauuaggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagcccauuguuaggaagugcucagcaugucgaggagugcuccuguuauccucgauauccuggugucagaugugucugcagagacaacuggaaaggcuccaauaggcccaucguagauauaaauguaaaggauuauagcauuguuuccagcuaugugugcucaggacuuguuggagacacacccagaaaaaacgacagauccagcaguagcaauugccugaauccuaacaaugaggaagggggucauggagugaaaggcugggccuuugaugauggaaaugacguguggaugggaagaacgaucagcgagaaguuacgcucagguuaugaaaccuucaaagucauugaaggaugguccaaaccuaacuccaaauugcagauaaauaggccagucauaguugacagaggugauagguccgguuauucuggcauuuuuucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44542 - RNA, 1410 nt, Artificial Sequence
  neuraminidase__InfluenzaA__AAG01786
augaauccaaaucaaaagauaauaacgauuggcucuguuucucucacuauugccacaaugugcuuccuuaugcaaauugccauccugguaacuacuguaacauugcauuucaagcaauaugaaugcaacucccccccaaacaaccaaguaauacugugugaaccaacaauaauagaaagaaacauaacagagauaguguaucugaccaacaccaccauagagaaggaaauaugccccaaacuagcagaauacaaaaauuggucaaagccgcaauguaaaauuacaggauuugcaccguuuuccaaggacaauucgauuaggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauauuauucauugaggaggggaaaaucguucauauuagcccauuguuaggaagugcucagcaugucgaggagugcuccuguuauccucgauauccuggugucagaugugucugcagagacaacuggaaaggcuccaauaggcccaucguagauauaaauguaaaggauuauagcauuguuuccagcuaugugugcucaggacuuguuggagacacacccagaaaaaacgacagauccagcaguagcaauugccugaauccuaacaaugaggaagggggucauggagugaaaggcugggccuuugaugauggaaaugacguguggaugggaagaacgaucagcgagaaauuacgcucagguuaugaaaccuucaaagucauugaaggcugguccaaaccuaacuccaaauugcagauaaauaggcaagucauagucgacagaggugauagguccgguuauucuggcauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44543 - RNA, 1410 nt, Artificial Sequence
  neuraminidase__InfluenzaA__AAK71688
augaauccaaaucaaaagauaauaacgauuggcucuguuucucucacuauugccacaaugugcuuccuuaugcaaauugccauccugguaacuacuguaacauugcauuucaagcaauaugaaugcaacucccccccaaacaaccaaguaauacugugugaaccaacaauaauagaaagaaacauaacagagauaguguaucugaccaacgccaccauagagaaggaaauaugccccaaacuagcagaauacagaaauuggucaaagccacaauguaaaauuacaggauuugcaccauuuuccaaggacaauucgauuaggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacuggacaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauauuauucauugaggaggggaaaaucguucauauuagcccauuguuaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagauccagcaguagcaauugccugaauccuaacaaugaggaaggaggucauggagugaaaggcugggccuuugaugauggaaaugacguguggaugggaagaacgaucagcgaggaguuacgcucagguuaugaaaccuucaaagucauugaaggcugguccaaaccuaauuccaaauugcagauaaauaggcaagucauaguugacagaggugacagguccgguuauucuggcauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44544 - RNA, 1410 nt, Artificial Sequence
  neuraminidase__InfluenzaA__AAN01169
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuacagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaauugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44545 - RNA, 1410 nt, Artificial Sequence
  neuraminidase__InfluenzaA__AAN01170
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaauugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44546 - RNA, 1410 nt, Artificial Sequence
  neuraminidase__InfluenzaA__AAN01171
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugguaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuccgcucagguuaugaaaccuucaaagucauugaaggcugguccaaaccuaauuccaaauugcagauaaauaggcaagucauaguugacagagauaauagguccgguuauucugguauuuucucuguugaaggcaaaagcugcaucaaucggugcuuuuauguggaauugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44547 - RNA, 1410 nt, Artificial Sequence; identical to SEQ ID NO: 44545
  neuraminidase__InfluenzaA__AAN01172

SEQ ID NO: 44548 - RNA, 1410 nt, Artificial Sequence
  neuraminidase__InfluenzaA__AAN01173
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggaaaugugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaauugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44549 - RNA, 1410 nt, Artificial Sequence; identical to SEQ ID NO: 44545
  neuraminidase__InfluenzaA__AAN01174

SEQ ID NO: 44550 - RNA, 1410 nt, Artificial Sequence; identical to SEQ ID NO: 44544
  neuraminidase__InfluenzaA__AAN01175

SEQ ID NO: 44551 - RNA, 1410 nt, Artificial Sequence
  neuraminidase__InfluenzaA__AAN01176
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccacaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaauugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44552 - RNA, 1410 nt, Artificial Sequence; identical to SEQ ID NO: 44545
  neuraminidase__InfluenzaA__AAN01177

SEQ ID NO: 44553 - RNA, 1410 nt, Artificial Sequence; identical to SEQ ID NO: 44545
  neuraminidase__InfluenzaA__AAN01178

SEQ ID NO: 44554 - RNA, 1410 nt, Artificial Sequence; identical to SEQ ID NO: 44545
  neuraminidase__InfluenzaA__AAN01179

SEQ ID NO: 44555 - RNA, 1410 nt, Artificial Sequence
  neuraminidase__InfluenzaA__AAN01180
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaauuauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaacgaggaagggggucauggagugaaaggcugggccuuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaauugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44556 - RNA, 1410 nt, Artificial Sequence
  neuraminidase__InfluenzaA__AAN01181
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggagauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucaugauggaaaagcauggcugcauguuuguguaacugggcacgaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucggcgagaaauuccgcucagguuaugaaacuuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44557 - RNA, 1410 nt, Artificial Sequence; identical to SEQ ID NO: 44545
  neuraminidase__InfluenzaA__AAN01182

SEQ ID NO: 44558 - RNA, 1410 nt, Artificial Sequence
  neuraminidase__InfluenzaA__AAN01183
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguugggugucccauuucauuugggaaccaagcaagugugcauagcaugguccagcucaaguugucacgauggaaaagcauggcugcauguuuguguaacugggcacgaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44559 - RNA, 1410 nt, Artificial Sequence; identical to SEQ ID NO: 44551
  neuraminidase__InfluenzaA__AAN01184

SEQ ID NO: 44560 - RNA, 1410 nt, Artificial Sequence
  neuraminidase__InfluenzaA__AAN01185
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaagauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaauugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44561 - RNA, 1410 nt, Artificial Sequence
  neuraminidase__InfluenzaA__AAN01186
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugauaaguguuaucaauuugcccuuggacagggaacaacacuaaacaacaggcauucaaacgacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaagauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuccgcuuagguuaugaaacuuucaaagucauugaaggcugguccaaaucuaacuccaaauugcagauaaauaggcaagucauaguugacagagauaauagguccgguuauucugguauuuucucuguugaaggcaaaagcuguaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44562 - RNA, 1410 nt, Artificial Sequence
  neuraminidase__InfluenzaA__AAN01187
augaauccaaaucaaaagauaauaacgauuggcucuguuucucucacuauugccacaauaugcuuccuuaugcaaauugccauccugguaacuacuguaacauugcauuucaagcaauaugaaugcgacucucucccaaacaaccaaguaaugcugugugaaccaacaauaauagaaagaaacauaacagagauaguguaucugaccaacaccaccauagagaaggaaaugugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaacgacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaaaugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44563 - RNA, 1410 nt, Artificial Sequence
  neuraminidase__InfluenzaA__AAN01188
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44564 - RNA, 1410 nt, Artificial Sequence
  neuraminidase__InfluenzaA__AAN64883
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacuggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauagguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggggacacacccagaaaaaacgacagcuccagcaguagccauugcuuggauccuaacaaugaggaagguggucauggagugaaaggcugggccuuugaugauggagaugacguguggaugggaagaacgaucagcgagaaguuacgcucaggauaugaaaccuucaaaguaauugaaggcugguccaaaccuaacuccaaacugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44565 - RNA, 1410 nt, Artificial Sequence
  neuraminidase__InfluenzaA__AAN64884
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacuggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcacucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauagguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggccuauuguagauauaaauguaaaggauuauagcauuguuuccaguuaugugugcucaggacuuguuggggacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44566 - RNA, 1410 nt, Artificial Sequence
  neuraminidase__InfluenzaA__AAN64885
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacuggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauagguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggggacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcaaauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44567 - RNA, 1410 nt, Artificial Sequence
  neuraminidase__InfluenzaA__AAN64886
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacuggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauagguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggggacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44568 - RNA, 1410 nt, Artificial Sequence
  neuraminidase__InfluenzaA__AAN64887
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacuggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauagguucauggucuaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggggacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44569 - RNA, 1410 nt, Artificial Sequence
  neuraminidase__InfluenzaA__AAN64888
augaauccaaaucaaaagauaauaacgauuggcucuguuucucucaccauugccacaauaugcuuccuuaugcaaauugucauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacuggauuugcaccuuuuucuaaggacaauucgauucggcuuuccgcugguggggacaucuggguuacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugauaaaaaugcaacugcuagcuucauuuacaaugggaggcuuguagauaguauagguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccaucguagacauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggaguugauaaggggaaggaaccaggaaacugaagucuuguggaccucaaacaguauuguuguguuuuguggcaccucagguacauauggaacaggcucauggccugauggggcggacaucaaucucaugccuauauaa

SEQ ID NO: 44570 - RNA, 1410 nt, Artificial Sequence; identical to SEQ ID NO: 44565
  neuraminidase__InfluenzaA__AAN64889

SEQ ID NO: 44571 - RNA, 1410 nt, Artificial Sequence
  neuraminidase__InfluenzaA__AAN64890
augaauccaaaucaaaagauaauaacgauuggcucuguuucucucaccauugccacaauaugcuuccuuaugcaaauugccauccugguaacuacuguaacauugcacuucaagcaauaugaaugcaacucccccccaaacaaccaagagaugcugugugaaccaacaauaauagaaagaaacauaacagagauaguguaucugaccaacaccaccauagagaaggaaauaugccccaaacuagcagaauacagaaauuggucaaagccgcaauguaacauuacuggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagacaguauagguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggggacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44572 - RNA, 1410 nt, Artificial Sequence
  neuraminidase__InfluenzaA__AAN64891
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacuggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauagguucaugguccaaaaaaauccucaggacccaggaaucggaaugcguuuguaucaauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggggacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44573 - RNA, 1410 nt, Artificial Sequence
  neuraminidase__InfluenzaA__AAO46212
augaauccaaaucaaaagauaauaacaauuggcucugucucucucaccauugaaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauacuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugucacgauggaaaagcaugguugcauguuugugucacuggggaugauagaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucagcaaagauuuacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 44574 - RNA, 1410 nt, Artificial Sequence
  neuraminidase__InfluenzaA__AAO46213
augaauccaaaucaaaagauaauaacaauugacucugucucucucaccauugcaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauacuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugucacgauggaaaagcaugguugcauguuugugucacuggggaugauagaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucagcaaagauuuacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 44575 - RNA, 1410 nt, Artificial Sequence
  neuraminidase__InfluenzaA__AAO46214
augaauccaaaucaaaagauaauaacaauuggcucugucucucucaccauugcaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagauuugccccgaagcaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugucacgauggaaaagcaugguugcauguuugugucacuggggaugauagaaaugcaacugcuagcuucauuuaugacgggaggcuuguggacaguauugguucauggucucaaaauauccucaggacccaggagucggaaugcguuuguaucaaugggauuugcacaguaguaaugacugauggaagugcaucaggaagagccgauacuagaauacuauucauugaagaggggaaaauuguccauauuagcccauugucaggaagugcucagcauguagaagaguguuccuguuauccucgauauccugacgucagauguaucugcagagacaacuggaaaggcucuaauaggcccguuauagacauaaauauggaagauuauagcauugauuccaguuaugugugcucagggcuuguuggcgacacacccagaaacgacgacagaucuagcaauagcaauugcagggauccuaacaaugagagagggaauccaggagugaaaggcugggccuuugacaauggagaugacguguggaugggaagaacgaucagcaaagauuuacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggcaacaggagacuagaguaugguggaccucaaacaguauuguuguguuuuguggcacuucagguacuuauggaacaggcucauggccugauggggcgaacaucaauuucaugccuauauaa

SEQ ID NO: 44576 - RNA, 1410 nt, Artificial Sequence
  neuraminidase__InfluenzaA__AAO46215
augaauccaaaucaaaagauaauaacaauuggcucugucucucucaccauugcaacaguaugcuuccucaugcagauugccauccuggcaacuacugugacauugcauuuuaaacaacaugagugcgacucccccacgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaccgaacccuauuaaugaaugaguuggguguuccauuucauuuaggaaccaaacaaguguguguagcaugguccagcucaaguugucacgauggaaaagcaugguugcauguuugugucacuggggaugauagaaaugcgacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacggcgacagcucuagcaauagcaauugcagggauccuaacaaugaaagagggaauccaggagugaaaggcugggccuuugacaauggagaugauguauggaugggaagaacaaucagcaaagaaucacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 44577 - RNA, 1410 nt, Artificial Sequence
  neuraminidase__InfluenzaA__AAO46216
augaauccaaaucaaaagauaauaacaauugguucugucucucucaccauugcaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuacgugucaugcgauccuagcaaguguuaucaauuugcacucgggcaggggaccacacuagaaaacaaacauucaaauggcacaaaacaugauagaaucccucaucgaacccuauuaaugaaugaguuggguguuccauuucauuuaggaaccaaacaaguguguguagcaugguccagcucaaguugucacgauggaaaagcaugguugcauguuugugucacuggggaugauagaaaugcaacugcuagcuucauuuaugaagggaggcuuguggacaguauuguuucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucagcaaagauucacgcucagguuaugaaacuuucaaagucauuggugguugguccacaccuaauuccaaaucgcaggucaauagacaggucauaguugacagcaauaauuggucugguuacucugguauuuucucuguugagggcaaaagcugcaucaauaggugcuuuuauguggaguuaauaaggggaaggccacaggagacuagaguaugguggacaucaaacaguauuguuguguuuuguggcacuucagguacuuauggaacaggcucauggccugauggggcgaacaucaauuucaugccuauauaa

SEQ ID NO: 44578 - RNA, 1410 nt, Artificial Sequence
  neuraminidase__InfluenzaA__AAO46217
augaauccaaaucaaaagauaauaacaauuggcucugucucucucaccauugcaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagauuugccccgaaguaguagaauacagaaauuggucaaagccgcaaugucaaauuacaggauuugcaccuuucucuaaggacaauucaauccggcuuucugcugguggggacauuugggugacgagagaaccuuaugugucaugugauccuagcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugccacgauggaaaagcaugguugcauguuugugucacuggggaugauagaaaugcaacugcuagcuucauuuaugacgggaggcuugaggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuuuagacauaaguauggaagauuauagcauugauuccaguuaugugugcucagggcuuguuggcgacacacccaggaacgacgacagcucuagcaauagcaacugcagggauccuaacaaugagagagggaauccaggagugaaaggcugggccuuugacaauggagaugauguauggaugggaagaacaaucagcaaagauuuacgcucagguuaugaaacuuucaaagucauuggugguugguccacaccuaacuccaaaucgcaggucaauagacaggucauaguggacaacaauaauuggucugguuacucugguauuuucucuguugagggcaaaagcugcaucaauaggugcuuuuauguggaguugauaaggggaaggucacaggagacuagaguaugguggaccucaaacaguauuguuguguucuguggcacuucaggcacuuauggaacaggcucauggccugauggggcgaacaucaauuucaugccuauauaa

SEQ ID NO: 44579 - RNA, 1410 nt, Artificial Sequence
  neuraminidase__InfluenzaA__AAO46218
augaauccaaaucaaaagauaauaacaauuggcucugucucucucaccauugcaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagauuugccccgaaguaguagaauacagaaauuggucaaagccgcaaugucaaauuacaggauuugcaccuuucucuaaggacaauucaauccggcuuucugcugguggggacauuugggugacgagagaaccuuaugugucaugugauccuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugccacgauggaaaagcaugguugcauguuugugucacuggggaugauagaaaugcaacugcuagcuucauuuaugacgggaggcuugaggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuuuagacauaaguauggaagauuauagcauugguuccaguuaugugugcucagggcuuguuggcgacacacccaggaacgacgacagcucuagcaauagcaacugcagggauccuaacaaugagagagggaauccgggagugaaaggcugggccuuugacaauggagaugauguauggaugggaagaacaaucagcaaagauuuacgcucagguuaugaaacuuucaaagucauuggugguugguccacaccuaacuccaaaucgcaggucaauagacaggucauaguggacaacaauaauuggucugguuacucugguauuuucucuguugagggcaaaagcugcaucaauaggugcuuuuauguggaguugauaaggggaaggucacaggagacuagaguaugguggaccucaaacaguauuguuguguucuguggcacuucagguacuuauggaacaggcucauggccugauggggcgaacaucaauuucaugccuauauaa

SEQ ID NO: 44580 - RNA, 1410 nt, Artificial Sequence
  neuraminidase__InfluenzaA__AAO46220
augaauccaaaucaaaagauaauaacaauuggcucugucucucucaccauugcaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagaucugccccgaagcaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccagacaaguguguguagcaugguccagcucaaguugucacgauggaaaagcaugguugcauguuugugucacuggggaugauagaaaugcaacugcuagcuucauuuaugacgggaggcuuguggacaguauugguucauggucucaaaauauccucaggacccaggagucggaaugcguuuguaucaaugggauuugcacaguaguaaugacugauggaagugcaucaggaagagccgauacuagaauacuauucauugaagaggggaaaauuguccauauuagcccauugucaggaagugcucagcauguagaggaguguuccuguuauccucgauauccugacgucagauguaucugcagagacaacuggaaaggcucuaauaggcccguuauagacauaaauauggaagauuauagcauugauuccaguuaugugugcucagggcuuguuggcgacacacccagaaacgacgacagaucuagcaauagcaauugcagggauccuaacaaugagagagggaauccaggagugaaaggcugggccuuugacaauggagaugacguguggaugggaagaacgaucagcaaagauuuacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggcaacaggagacuagaguaugguggaccucaaacaguauuguuguguuuuguggcacuucagguacuuauggaacaggcucauggccugauggggcgaacaucaauuucaugccuauauaa

SEQ ID NO: 44581 - RNA, 1410 nt, Artificial Sequence
  neuraminidase__InfluenzaA__AAO46221
augaauccaaaucaaaagauaauaacaauuggcucugucucucucaccauugcaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagaucugccccgaagcagcggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccagacaaguguguguagcaugguccagcucaaguugucacgauggaaaagcaugguugcauguuugugucacuggggaugauagaaaugcaacugcuagcuucauuuaugacgggaggcuuguggacaguauugguucauggucucaaaauauccucaggacccaggagucggaaugcguuuguaucaaugggauuugcacaguaguaaugacugauggaagugcaucaggaagagccgauacuagaauacuauucauugaagaggggaaaauuguccauauuagcccauugucaggaagugcucagcauguagaagaguguuccuguuauccucgauauccugacgucagauguaucugcagagacaacuggaaaggcucuaauaggcccguuauagacauaaauauggaagauuauagcauugauuccaguuaugugugcucagggcuuguuggcgacacacccagaaacgacgacagaucuagcaauagcaauugcagggauccuaacaaugagagagggaauccaggagugaaaggcugggccuuugacaauggagaugacguguggaugggaagaacgaucagcaaagauuuacgcucagguuaugaaacuuucaaagucauuggugguugguccacaccuaauuccaaaucgcaggucaauagacagguuauaguugacaacaauaauuggucugguuacucugguauuuucucuguugagggcaaaagcugcaucaauaggugcuuuuauguggaguugauaaggggaaggcaacaggagacuagaguaugguggaccucaaacaguauuguuguguuuuguggcacuucagguacuuauggaacaggcucauggccugauggggcgaacaucaauuucaugccuauauaa

SEQ ID NO: 44582 - RNA, 1410 nt, Artificial Sequence
  neuraminidase__InfluenzaA__AAO46223
augaauccaaaucaaaagauaauaacaauuggcucugucucucucaccauugcaacaguaugcuuccucaugcagauugccauccugguaacuacuguaacauugcauuuuaagcaacaugagugcgacucccccgcgagcaaccaaguaaugccaugugaaccaauaauaauagaaaggaacauaacagagauaguguauuugaauaacaccaccauagagaaagagaucugccccgaaguaguggaauacagaaauuggucaaagccacaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguguagcaugguccagcucaaguugucacgauggaaaagcaugguugcauguuugugucacuggggaugauaaaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaauguuccuguuauccucgauauccugacgucagauguaucugcagagacaacuggaaaggcucuaauaggcccguuauagacauaaauauggaagauuauagcauugauuccaguuaugugugcucagggcuuguuggcgacacacccagaaacgacgacagaucuagcaauagcaauugcagggauccuaacaaugagagagggaauccaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaggucauaguugacagcaauaauuggucagguuacucugguauuuucucuguugagggcaaaagcugcaucaauaggugcuuuuauguggaguugauaaggggaaggaaacaggagacuagaguaugguggaccucaaacaguauuguuguguuuuguggcacuucagguacuuauggaacaggcucauggccugauggggcgaacaucaauuucaugccuauauaa

SEQ ID NO: 44583 - RNA, 1410 nt, Artificial Sequence; identical to SEQ ID NO: 44582
  neuraminidase__InfluenzaA__AAO46224

SEQ ID NO: 44584 - RNA, 1410 nt, Artificial Sequence
  neuraminidase__InfluenzaA__AAO46225
augaauccaaaucaaaagauaauaacaauuggcuuugucucucucaucauugcaacaguaugcuuccucaugcagauugccauccuggcaacuacugugacauugcauuuuaagcaacaugagugcgacucccccgcaagcaaccaaguaaugccaugugaaccaauaauaauagaaaggaacauaacaaagauaguguauuugaauaacaccaccauagagaaagagaucugccccgaaguaguggaauacagaaauuggucaaagccgcaaugucacauuacaggauuugcaccuuuuucuaaggacaauucaauccgacuuucugcugguggggacauuugggugacgagagaaccuuaugugucaugcgauccuggcaaguguuaucaauuugcacucgggcaggggaccacacuagacaauaaacauucaaaugacacaauacaugauagaaucccucaucgaacccuauuaaugaaugaguuggguguuccauuucauuuaggaaccagacaaguguguguagcaugguccagcucaaguugucaugauggaaaagcaugguugcauguuugugucacuggggaugauaaaaaugcaacugcuagcuucauuuaugacgggaggcuuguggacaguauugguucauggucucacaauauccucaggacccaggagucggaaugcguuuguaucaaugggacuugcacaguaguaaugacugauggaagugcaucaggaagagccgauacuagaauacuauucauuaaagaggggaaaauuguccacauuagcccauugucaggaagugcucagcauguagaggaguguuccuguuauccucgauauccugacgucagauguaucugcagagacaacuggaaaggcuccaauaggcccguuauagacauaaauauggaagauuauagcauugauuccaguuaugugugcucagggcuuguuggcgacacacccagaaacaacgacggaucuagcaauagcaauugcagggauccuaacaaugagagagggaauccaggagugaaaggcugggccuuugacaauggagaugacguguggaugggaagaacgaucaguaaagauuuacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggcaacaggagacuagaguaugguggaccucaaacaguauuguuguguuuuguggcacuucagguacuuauggaacaggcucauggccugauggggcgaacaucaauuucaugccuauauaa

SEQ ID NO: 44585 - RNA, 1410 nt, Artificial Sequence
  neuraminidase__InfluenzaA__AAO46226
augaauccaaaucaaaagauaauaacaauuggcucugucucucucaccauugcaacaguaugcuuccucaugcagauugccauccugguaacuacuguaacauugcauuuuaagcaacaugagugcgacucccccgcgagcaaccaaguaaugccaugugaaccaauaauaauagaaaggaacauaacagagauaguguauuugaauaacaccaccauagagaaagagaucugccccgaaguaguggaauacagaaauuggucaaagccgcaaugucaaauuacaggauuugcaccuuuuuccaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguguagcaugguccagcucaaguugucacgauggaaaagcaugguugcauguuugugucacuggggaugaugaaaaugcaacugcuagcuucauuuaugacgggaggcuuguggacaguauugguucauggucucaaaauauccucaggacccaggagucggaaugcguuuguaucaauggaacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccugacgucagauguaucugcagagacaacuggaaaggcucuaauaggcccgucauagacauaaauauggaagauuauagcauugauuccaguuaugugugcucagggcuaguuggcgacacacccagaaacgacgacagaucuagcaauagcaauugcagggauccuaacaaugagagagggaauccaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaggucauaguugacagcaauaauuggucagguuacucugguauuuucucuguugagggcaaaagcugcaucaauaggugcuuuuauguggaguugauaaggggaaggcaacaggagacuagaguaugguggaccucaaacaguauuguuguguuuuguggcacuucagguacuuauggaacaggcucauggccugauggggcgaacaucaauuucaugccuauauaa

SEQ ID NO: 44586 - RNA, 1410 nt, Artificial Sequence
  neuraminidase__InfluenzaA__AAO46229
augaauccaaaucaaaagauaauaacaauuggcucugucucucucaccauugcaacaguaugcuuccucaugcagauugccauccugguaacuacuguaacauugcauuuuaagcaacaugagugcgacucccccgcgagcaaccaaguaaugccgugugaaccaauaauaauagaaaggaacauaacagagauaauguauuugaauaacaccaccauagagaaagagaucugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguguagcaugguccagcucaaguugucacgauggaaaagcaugguugcauguuugugucacuggggaugauaaaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccugacgucagauguaucugcagagacaacuggaaaggcucuaauaggcccaucauagacauaaauauggaagauuauagcauugauuccaguuaugugugcucagggcuuguuggcgacacacccagaaacgacgacagaucuagcaauaguaauugcaggaauccuaacaaugagagagggaauccaggagugaaaggcugggccuuugacaauggagaugacguguggaugggaagaacaaucagcaaggauuuacgcucagguuaugaaacuuucaaagucauuggugguugguccacaccuaauuccaaaucgcagaucaauagacaggucauaguugacagcaauaauuggucagguuacucugguauuuucucuguugagggcaaaagcugcaucaauaggugcuuuuauguggaguugauaaggggaaggcaacaggagacuagaguaugguggaccucaaacaguauuguuguguuuuguggcacuucagguacuuauggaacaggcucauggccugauggggcgaacaucaauuucaugccuauauaa

SEQ ID NO: 44587 - RNA, 1410 nt, Artificial Sequence
  neuraminidase__InfluenzaA__AAO46230
augaauccaaaucaaaagauaauaacgauuggcucugucucucucaccauugcaacaguaugcuuccucaugcagauugccauccugguaacuacuguaacauugcauuuuaagcaacaugagugcgacucccccgcgagcaaccaaguaaugccgugugaaccaauaauaauagaaaggaaccuaacagagauaguguauuugaauaacaccaccauagagaaagagaucugccccgaaguaguggaauacagaaauuggucaaagccgcaaugucaaauuacaggauuugcaccuuuuucuaaggacaauucuauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguguagcaugguccagcucaaguugucacgauggaaaagcaugguugcauguuugugucacuggggaugauaaaaacgcaacugcuagcuucauuuaugacgggaggcuuguggacaguauugguucauggucucaaaauauccucaggacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccugacgucagauguaucugcagagacaacuggaaaggcucuaauaggcccgucauagacauaaauauggaagauuauagcauugauuccaguuaugugugcucagggcuuguuggcgacacacccagaaacgacgacagaucuagcaauaguaauugcagggauccuaacaaugagagagggaauccaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaggucauaguugacagcaauaauuggucagguuacucugguauuuucucuguugagggcaaaagcugcaucaauaggugcuuuuauguggaguugauaaggggaaggcaacaggagacuagaguaugguggaccucaaacaguauuguuguguuuuguggcacuucagguacuuauggaacaggcucauggccugauggggcgaacaucaauuucaugccuauauaa

SEQ ID NO: 44588 - RNA, 1410 nt, Artificial Sequence
  neuraminidase__InfluenzaA__AAO46231
augaauccaaaucaaaagauaauaacaauuggcucugucucucucaccauugcaacaguaugcuuucucaugcagauugccauccugguaacuacuguaacauugcacuuuaagcaacaugauugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccugucaaguguuaucaauuugcacucgggcaggggaccacacuagacaacaaacauucaaaugacacaguacaugauagaaucccucaucgaacccuauuaaugaaugaguuggguguuccauuucacuuaggaaccaggcaaguguguauagcaugguccagcucaaguugucacgauggaaaagcaugguugcauguuugugucacuggggaugauaaaaacgcaacugcuagcuucauuuaugacgggaggcuuguggacaguauugguucauggucucaaaauauccucaggacccaggagucggaaugcguuuguaucaaugggacuugcacaguaguaaugacugauggaagugcuucaggaagagccgauacuagaauacuauucauugaagaggggaaaauuguccauauuagcccauugucgggaagugcucagcauguagaggaguguuccuguuauccucgauauccugacgucagauguaucugcagagacaacuggaaaggcucuaauaggcccgucauagacauaaauauggaagauuauagcauugauuccaguuaugugugcucagggcuuguuggugacacacccagaaacgacgacagaucuagcaauaguaauugcaggaauccuaacaaugagagagggaauccaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaggucauaguugacagcaauaauuggucagguuacucugguauuuucucuguugagggcaaaagcugcaucaauaggugcuuuuauguggaguugauaaggggaaggcaacaggagacuagaguaugguggaccucaaacaguauuguuguguuuuguggcacuucagguacuuauggaacaggcucauggccugauggggcgaacaucaauuucaugccuauauaa

SEQ ID NO: 44589 - RNA, 1410 nt, Artificial Sequence
  neuraminidase__InfluenzaA__AAO46232
augaauccaaaucaaaagauaauaacaauuggcucugucucucucaccauugcaacaguaugcuuccucaugcagauugccauccugguaacuacuguaacauugcacuuuaagcaacaugagugcgacucccccgcgagcaaccaaguaaugccgugugaaccaacaauaauagaaaggaacauaacagagauaguguaccugaacaacaccaccauagagaaagagaucugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcagggaaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccugacgucagauguaucugcagagacaacuggaaaggcucuaauaggcccaucauagacauaaauauggaagauuauagcauugauuccaguuaugugugcucagggcuuguuggcgacacacccagaaacgacgacagaucuagcaauagcaauugcaggaauccuaacaaugagagagggaauccaggagugaaagggugggccuuugacaauggagaugacguguggaugggaagaacgaucagcaaggauuuacgcucagguuaugaaacuuucaaagucauuggugguuggucuacaccuaauuccaaaucgcagaucaauagacaagucauaguugacagcaauaauuggucagguuacucugguauuuucucuguugagggcaaaagcugcaucaauaggugcuuuuauguggaguugauaaggggaaggcaacaggagacuagaguaugguggaccucaaacaguauuguuguguuuuguggcacuucagguacuuauggaacaggcucauggccugauggggcgaacaucaauuucaugccuauauaa

SEQ ID NO: 44590 - RNA, 1410 nt, Artificial Sequence
  neuraminidase__InfluenzaA__AAO46233
augaauccaaaucaaaagauaauaacaauuggcucugucucucucaccauugcagcaguaugcuuccucaugcagauugccauccugguaacuacuguaacauugcauuuuaagcaacaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccugacgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaauccaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcaauaaucggucagguuacucugguauuuucucuguugagggcaaaggcugcaucaauaggugcuuuuauguggaguugauaaggggaaggcaacaggagacuagaguaugguggaccucaaacaguauuguuguguuuuguggcacuucagguaccuauggaacaggcucauggccugauggggcgaacaucaauuucaugccuauauaa

SEQ ID NO: 44591 - RNA, 1410 nt, Artificial Sequence
  neuraminidase__InfluenzaA__AAO46235
augaauccaaaucaaaagauaauaacaauuggcucugucucucucaccauugcaacaguaugcuuccucaugcagauugccauccugguaacuacuguaacauugcauuuuaagcaacaugagugcgacucccccgcgagcaaccaaguaaugccgugugaaccaauaauaauagaaaggaacauaacagagauaguguauuugaauaacacuaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugauaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagaguaugguggaccucaaacaguauuguuguguuuuguggcacuucagguaccuauggaacaggcucauggccugauggggcgaacaucaauuucaugccuauauaa

SEQ ID NO: 44592 - RNA, 1410 nt, Artificial Sequence
  neuraminidase__InfluenzaA__AAO46236
augaauccaaaucaaaagauaauaacaauuggcucugucucucucaccauugcaacaguaugcuuccucaugcauauugccauccugguaacuacuguaacauugcauuuuaagcaacaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugauaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagaguaugguggaccucaaacaguauuguuguguuuuguggcacuucagguaccuauggaacaggcucauggccugauggggcgaacaucaauuucaugccuauauaa

SEQ ID NO: 44593 - RNA, 1410 nt, Artificial Sequence
  neuraminidase__InfluenzaA__AAO46237
augaauccaaaucaaaagauaauaacaauuggcucugucucucucaccauugcaacaguaugcuuccucaugcagauugccauccugguaacuacuguaacauugcauuuuaagcaacaugagugcgacucccccgcgagcaaccaaguaaugccgugugaaccaauaauaauagaaaggaacauaacagagauaguguauuugaauaacaccaccauagagaaagagauaugccccaaaauaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugauaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccuggcgucagauguaucugcagagacaacuggaaaggcucuaauaggcccgucguagacauaaauauggaagauuauagcauugauuccaguuaugugugcucaggccuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagaguaugguggaccucaaacaguauuguuguguuuuguggcacuucagguaccuauggaacaggcucauggccugauggggcgaacaucaauuucaugccuauauaa

SEQ ID NO: 44594 - RNA, 1410 nt, Artificial Sequence
  neuraminidase__InfluenzaA__AAO46238
augaauccaaaucaaaagauaauaacaauuggcucugccucucucaccauugcaacaguaugcuuccucaugcagauugccauccugguaacuacuguaacauugcauuucaagcaacaugagugcgacucucccgcgagcaaccaaguaaugccgugugaaccaauaauaauagaaaggaacauaacagagauaguguauuugaauaacaccaccauagagaaagagauaugccccaaaauaguggaauacagaaauuggucaaagccgcaauguaaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauugaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuaugacgggaggcuuguggacaguauugguucauggucucaaaauauccucaggacccaggagucggaaugcguuuguaucaaugggacuuguacaguaguaaugacugauggaagugcuucaggaagagccgauacuagaauacuauucauugaagaggggaaaauuguccauauuagcccauugucaggaagugcucagcauguagaggaguguuccuguuauccucgauauccugacgucagauguaucugcagagacaacuggaaaggcucuaauaggcccgucguagacauaaauauggaagauuauagcauugauuccaguuaugugugcucagggcuuguuggagacacaccuagaaacgacgacagaucuagcaauagcaauugcagaaauccuaacaaugagaaagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauaggcaagucauaguugacagcgauaauaggucagguuauucugguauuuucucuguugagggcaaaagcugcaucaauaggugcuuuuauguggaguugauaaggggaaggaaacaggagacuagaguaugguggaccucaaacaguauuguuguguucuguggcacuucagguaccuaugggacaggcucauggccugauggggcgaacaucaaucucaugccuauauaa

SEQ ID NO: 44595 - RNA, 1410 nt, Artificial Sequence
  neuraminidase__InfluenzaA__AAO46241
augaauccaaaucaaaagauaauaacaauuggcucugucucucucaccauugcaacaguaugcuuccucaugcagauugccauccugguaacuacuguaacauugcauuuuaagcaacaugagugcgacucccccgcgagcaaccaaguaaugccgugugaaccaauaauaauagaaaggaacauaacagagauaguguauuugaauaacaccaccauagagaaagagauaugcccaaaaguagugggauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucaucuaggaaccaggcaaguguguauagcaugguccagcucaaguugucacgauggaaaagcauggcugcauguuuguaucacuggggaugauaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccgggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacuccgguauuuucucuguugagggcaaaagcugcaucaauaggugcuuuuauguggaguugauaaggggaaggaaacaggaaacuagaguaugguggaccucaaacaguauuguuguguuuuguggcacuucagguaccuauggaacaggcucauggccugauggggcgaacaucaauuucaugccuauauaa

SEQ ID NO: 44596 - RNA, 1410 nt, Artificial Sequence
  neuraminidase__InfluenzaA__AAO46245
augaauccaaaucaaaagauaauaacaauuggcucugucucucucaccauugcaacaguaugcuuucucaugcagauugccauccugguaacuacuguaacauugcacuuuaagcaacaugauugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccugucaaguguuaucaauuugcacucgggcaggggaccacacuagacaacaaacauucaaaugacacaguacaugauagaaucccucaucgaacccuauuaaugaaugaguuggguguuccauuucacuuaggaaccaggcaaguguguauagcaugguccagcucaaguugucacgauggaaaagcauggcugcauguuuguaucacuggggaugauaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauuggcaggaagugcucagcauguagaggaguguuccuguuauccucgauauccuggcgucagauguaucugcagagacaacuggaaaggcucuaauaggcccgucguagacauaaauauggaagauuauagcauugauuccaguuaugugugcucagggcuuguuggcgacacaccuagaaacgaugacagaucuagcaauagcaauugcaggaauccuaacaaugagagagggacucaaggagugaaaggcugggccuuugacaauggaaaugacuuguggaugggaagaacaaucagcaaggauuuacgcucagguuaugaaacuuucaaagucauuggugguugguccacaccuaauuccaaaucgcagaucaauagacaagucauaguugacagugauaaucggucagguuacucugguauuuucucuguugagggcaaaagcugcaucaauaggugcuuuuauguggaguugauaaggggaaggaaacaggagacuagaguaugguggaccucaaacaguauuguuguguuuuguggcacuucagguaccuauggaacaggcucauggccugauggggcgaacaucaauuucaugccuauauaa

SEQ ID NO: 44597 - RNA, 1410 nt, Artificial Sequence
  neuraminidase__InfluenzaA__AAO46246
augaauccaaaucaaaagauaauaacaauuggcucugucucucucaccauugcaacaguaugcuuccucaugcagauugccauccuggcaacuacuguaacauugcauuuuaagcagcaugagugcgacuccccagcaagcaaccaaguaaugccgugugaaccaauaauaauagaaaggaacauaacagagauaguguacuugaauaacaccaucauagagaaagagauaugccccaaaguaguggaauacagaaauuggucaaagccgcaaugucaaauuacaggauuugcacccuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauuaaugaaugaguuggguguuccauuucauuuaggaaccaggcaaguguguauagcaugguccagcucaaguugucacgauggaaaagcauggcugcauguuuguaucacuggggaugauaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacaaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagaguaugguggaccucaaacaguauugcuguguuuuguggcacuucagguaccuauggaacaggcucauggccugauggggcgaacaucaauuuuaugccuauauaa

SEQ ID NO: 44598 - RNA, 1410 nt, Artificial Sequence
  neuraminidase__InfluenzaA__AAO46247
augaauccaaaucaaaagauaauaacaauuggcucugucucucucaccauugcaacaguaugcuuccucaugcagauugccauccugguaacuacuguaacauugcauuuuaagcaacaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaagggaccacacuagacaacaaacauucaaaugacacaauacaugauagaaucccucaucgaacccuauuaaugaaugaguuggguguuccauuucauuuaggaaccaggcaaguguguauagcaugguccagcucaaguugccacgauggaaaagcauggcugcauguuuguaucacuggggaugauaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccuggcgucagauguaucugcagagacaacuggaaaggcucuaauaggcccgucauagacauaaauauggaagauuauagcauugauuccaguuaugugugcucagggcuuguuggcgacacaccuagaaacgacgacagaucuagcaauagcaauugcaggaacccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagaguaugguggaccucaaacaguauuguuguguuuuguggcacuucagguaccuauggaacaggcucauggccugauggggcgaacaucaauuucaugccuauauaa

SEQ ID NO: 44599 - RNA, 1410 nt, Artificial Sequence
  neuraminidase__InfluenzaA__AAO46462
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 44600 - RNA, 1410 nt, Artificial Sequence; identical to SEQ ID NO: 44599
  neuraminidase__InfluenzaA__AAO46463

SEQ ID NO: 44601 - RNA, 1410 nt, Artificial Sequence; identical to SEQ ID NO: 44599
  neuraminidase__InfluenzaA__AAO46464

SEQ ID NO: 44602 - RNA, 1410 nt, Artificial Sequence; identical to SEQ ID NO: 44599
  neuraminidase__InfluenzaA__AAO46465

SEQ ID NO: 44603 - RNA, 1410 nt, Artificial Sequence
  neuraminidase__InfluenzaA__AAO46466
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagaguaugguggaccucaaacaguauuguuguguuuuguggcacuucagguaccuauggaacaggcucauggccugauggggcgaacaucaauuucaugccuauauaa

SEQ ID NO: 44604 - RNA, 1410 nt, Artificial Sequence
  neuraminidase__InfluenzaA__AAO46467
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugacaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 44605 - RNA, 1410 nt, Artificial Sequence
  neuraminidase__InfluenzaA__AAO46468
augaauccaaaucaaaagauaauaacaauuggcucugucucucucaccauugcaacaguaugcuuccucaugcagauugccauccugguaacuacuguaacauugcauuuuaagcaauaugagugcgacuuccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 44606 - RNA, 1410 nt, Artificial Sequence
  neuraminidase__InfluenzaA__AAO46469
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcagggaaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguagacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 44607 - RNA, 1410 nt, Artificial Sequence
  neuraminidase__InfluenzaA__AAO46471
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggaccugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagaguaugguggaccucaaacaguauuguuguguuuuguggcacuucagguaccuauggaacaggcucauggccugauggggcgaacaucaauuucaugccuauauaa

SEQ ID NO: 44608 - RNA, 1410 nt, Artificial Sequence
  neuraminidase__InfluenzaA__AAO46472
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaacaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuagugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaagcaggagacuagaguaugguggaccucaaacaguauuguuguguuuuguggcacuucagguaccuauggaacaggcucauggccugauggggcgaacaucaauuucaugccuauauaa

SEQ ID NO: 44609 - RNA, 1410 nt, Artificial Sequence; identical to SEQ ID NO: 44599
  neuraminidase__InfluenzaA__AAO46473

SEQ ID NO: 44610 - RNA, 1410 nt, Artificial Sequence; identical to SEQ ID NO: 44599
  neuraminidase__InfluenzaA__AAO46474

SEQ ID NO: 44611 - RNA, 1410 nt, Artificial Sequence
  neuraminidase__InfluenzaA__AAO46475
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaauaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 44612 - RNA, 1410 nt, Artificial Sequence
  neuraminidase__InfluenzaA__AAO46476
augaauccaaaucaaaagauaauaacaauuggcucugucucucucaccauugcaacaguaugcuuccucaugcagauugccauccugguaacuacuguaacauugcauuucaggcaauaugagugcgacucccccgcgaacaaccaaguaaugccgugugaaccaacaauaauagaaaggaacauaacagagauaguguauuugaauaacaccaccauagagaaagagauaugccccaaauuaguggaauacagaaauuggucaaagccgcaauguaaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauugaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuaugacgggaggcuuguggacaguauugguucauggucucaaaauauccucaggacccaggagucggaaugcguuuguaucaaugggacuuguacaguaguaaugacugauggaagugcuucgggaagagcugauacuagaauacuauucauugaagaggggaaaauuguccauauuagcccauugucaggaagugcucagcauguagaggaguguuccuguuauccucgauauccuggcgucagauguaucugcagagacaacuggaaaggcucuaauaggcccgucguagauauaaauguggaagauuauagcauugauuccaguuaugugugcucagggcuuguuggcgacacacccagaaacaacgacagaucuagcaauagcaauugcaggaauccuaacaaugagagagggaaucacggagugaaaggcugggccuuugacgauggaaaugacguguggaugggaagaacgaucagcaaggauuuacgcucagguuaugaaaccuucaaagucauuggugguugguccacaccuaauuccaaaucgcagauaaauaggcaagucauaguugacagcgauaauaggucagguuauucugguauuuucucuguugagggcaaaagcugcaucaauaggugcuuuuauguggaguuaauaaggggaagggaacaggagacuagaguaugguggaccucaaacaguauuguuguguuuuguggcacuucagguaccuaugggacaggcucauggccugauggggcggacaucaaucucaugccuauauaa

SEQ ID NO: 44613 - RNA, 1410 nt, Artificial Sequence; identical to SEQ ID NO: 44611
  neuraminidase__InfluenzaA__AAO46477

SEQ ID NO: 44614 - RNA, 1410 nt, Artificial Sequence
  neuraminidase__InfluenzaA__AAO46478
augaauccaaaucaaaagauaauaacaauuggcucugucucucucaucauugcaacaguaugcuuccucaugcagauugccauccugguaacuacuguaacauugcauuuuaaacaacaugagugcgacucccccucgagcaaccaaguaaugccgugugaaccaauaauaauagaaaggaacauaacagagauaguguauuugaauaacaccaccauagagaaagagacaugccccaaauuaguggaauacagaaauuggucaaagccgcaauguaaaauuacaggauuugcaccuuuuucuaaggacaauucaauccgacucucugcugguggggacauuuggguuacgagagagccuuaugugucaugcgauccuggcaaguguuaucaauuugcacucgggcaggggaccacacuagacaacaaacauucaaaugacacaauacaugauagaaucccacaucgaacccuauugaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuaugacgggaggcuuguggacaguauugguucauggucucaaaauauccucaggacccaggagucggaaugcguuuguaucaaugguacuugcacaguaguaaugacugaugggaaugcuucagggagagccgauacuagaauacuauucauugaagaggggaaaauuguccauauuagcccauugucaggaagugcucagcauguagaggaguguuccuguuauccucgauauccugacgucagauguaucugcagagacaacuggaaaggcucuaauaggcccaucguagacauaaauaugaaagauuauagcauugauuccaguuaugugugcucagggcuuguuggcgacacaccuagaaacgacgacagaucuagcaagagcaauugcaggaauccuaacaaugagagagggaaucacggagugaaaggcugggccuuugacaauggaaaugacguguggaugggaagaacgaucagcaaggauuuacgcucagguuaugaaacuuucaaagucauuggugguugguccacaccuaauuccaaaucgcagaucaauaggcaagucauaguugacagcgauaaucggucagguuauucugguauuuucucuguugagggcaaaagcugcaucaauaggugcuuuuauguggaguugauaaggggaagggaacaggagacuagaguaugguggacuucaaacaguauuguuguguuuuguggcacuucagguaccuauggaacaggcucauggccugauggggcgaacaucaacuucaugccuauauaa

SEQ ID NO: 44615 - RNA, 1410 nt, Artificial Sequence
  neuraminidase__InfluenzaA__AAO46479
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccgaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgguaaucggucagguuacucugguauuuucucuguugagggcaaaagcugcaucaauaggugcuuuuauguggaguugauaaggggaaggaaacaggagacuagaguaugguggaccucaaacaguauuguuguguuuuguggcacuucaggcaccuauggaacaggcucauggccugauggggcgaacaucaauuucaugccuauauaa

SEQ ID NO: 44616 - RNA, 1410 nt, Artificial Sequence
  neuraminidase__InfluenzaA__AAO46481
augaauccaaaucaaaagauaauaacaauuggcucugucucucucaccauugcaacaguaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauugaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuacgaugggaggcuuguggacaguauugguucauggucucaaaauauccucaggacccaggagucggaaugcguuuguaucaaugggacuuguacaguaguaaugacugauggaagugcuucaggaagagcugauacuagaauacuauucauugaagaggggaaaauuguccacauuagcccauugucaggaagugcucagcauguagaggaguguuccuguuauccucgauauccuggcgucagauguaucugcagagacaacuggaaaggcucuaauaggcccgucguagauauaaaugugaaagauuauagcauugauucccguuaugugugcucagggcuuguuggcgacacacccagaaacaacgacagaucuagcaauagcaauugcaggaauccuaacaaugagagagggaaucauggagugaaaggcugggccuuugacgauggaaaugacguguggaugggaagaacgaucagcaaggauucacgcucagguuaugaaaccuucaaagucauuggugguugguccacaccuaauuccaaaucgcagauaaauaggcaagucauaguugacagcgauaauaggucagguuauucugguauuuucucuguugagagcaaaagcugcaucaauaggugcuuuuacguggaguugauaaggggaagggaacaggagacuagaguaugguggaccucaaacaguauuguuguguuuuguggcacuucagguaccuaugggacaggcucauggccugauggggcggacaucaaucucaugccuauauaa

SEQ ID NO: 44617 - RNA, 1410 nt, Artificial Sequence
  neuraminidase__InfluenzaA__AAO46482
augaauccaaaucaaaagauaauaacaauuggcucugucucucucaccauugcaacaguaugcuuccucaugcagauugccauccugguaacuacuguaacauugcauuucaagcaauaugagugcgacucccccgcgaacaaccaaguaaugccgugugaaccaaugauaauagaaaggaacauaacagagauaguguauuugacuaacaccaccauagagaaagagauaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauugaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuacgaugggagacuuguggacaguauugguucauggucucaaaauauccucaggacccaggagucggaaugcguuuguaucaaugggacuuguacaguaguaaugacugauggaagugcuucaggaagagcugauacuagaauacuauucauugaagaggggaaaauuguccauauuagcccauugucaggaagugcucagcauguagaggaguguuccuguuauccucgauauccuggcgucagauguaucugcagagacaacuggaaaggcucuaauaggcccgucguagauauaaaugugaaagauuauagcauugauucccguuaugugugcucagggcuuguuggcgacacacccagaaacaacgacagaucuagcaauagcaauugcaggaauccuaacaaugauaaagggaaucauggagugaaaggcugggccuuugacgauggaaaugacguguggaugggaagaacgaucagcaaggauucacgcucagguuaugaaaccuucaaagucauuggugguugguccacaccuaauuccaaaucgcagauaaauaggcaagucauaguugacagcgauaauaggucagguuauucugguauuuucucuguugagggcaaaagcugcaucaauaggugcuuuuacguggaguugauaaggggaagggaacaggagacuagaguaugguggaccucaaacaguauuguuguguuuuguggcacuucagguaccuaugggacaggcucauggccugauggggcggacaucaaucucaugccuauauaa

SEQ ID NO: 44618 - RNA, 1410 nt, Artificial Sequence
  neuraminidase__InfluenzaA__AAO46483
augaauccaaaucaaaagauaauaacaauuggcucugucucucucaccauugcaacaguaugcuuccucaugcagauugccauccugguaacuacuguaacauugcauuucaggcaauaugagugcgacucccccgcgaacaaccaaguaaugccgugugaaccaauaauaauagaaaggaacauaacagagauaguguauuugaauaacaccaccauagagaaagagauaugccccaaauuaguggaauacagaaauuggucaaagccgcaauguaaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauugaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuaugacgggaggcuuguggacaguauugguucauggucucaaaauauccucaggacccaggagucggaaugcguuuguaucaaugggacuuguacaguaguaaugacugauggaagugcuucaggaagagcugauacuagaauacuauucauugaagaggggaaaauuguccauauuagcccauugucaggaagugcucagcauguagaggaguguuccuguuauccucgauauccuggcgucagauguaucugcagagacaacuggaaaggcucuaauaggcccgucguagauauaaauguggaagauuauagcauugauuccaguuaugugugcucagggcuuguuggcgacacacccagaaacaacgacagaucuagcaauagcaauugcaggaauccuaacaaugagagagggaaucacggagugaaaggcugggccuuugacgauggaaaugacguguggaugggaagaacgaucagcaaggauuuacgcucagguuaugaaaccuucaaagucauuggugguugguccacaccuaauuccaaaucgcagauaaauaggcaagucauaguugacagcgauaauaggucagguuauucugguauuuucucuguugagggcaaaagcugcaucaauaggugcuuuuauguggaguuaauaaggggaagggaacaggagacuagaguaugguggaccucaaacaguauuguuguguuuuguggcacuucagguaccuaugggacaggcucauggccugauggggcggacaucaaucucaugccuauauaa

SEQ ID NO: 44619 - RNA, 1410 nt, Artificial Sequence
  neuraminidase__InfluenzaA__AAO46485
augaauccaaaucaaaagauaauaacaauuggcucugucucucucaccauugcaacaguaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauugaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuacgaugggagacuuguggacaguauugguucauggucucaaaauauccucaggacccaggagucggaaugcguuuguaucaaugggacuuguacaguaguaaugacugauggaagugcuucaggaagagcugauacuagaauacuauucauugaagaggggaaaauuguccauauuagcccauugucaggaagugcucagcauguagaggaauguuccuguuauccucgauauccuggcgucagauguaucugcagagacaacuggaaaggcucuaauaggcccgucguagauauaaaugugaaagauuauagcauugauucccguuaugugugcucagggcuuguuggcgacacacccagaaacaacgacagaucuagcaauagcaauugcaggaauccuaacaaugauaaagggaaucauggagugaaaggcugggccuuugacgauggaaaugacguguggaugggaagaacgaucagcaaggauucacgcucagguuaugaaaccuucaaagucauuggugguugguccacaccuaauuccaaaucgcagauaaauaggcaagucauaguugacagcgauaauaggucagguuauucugguauuuucucuguugagggcaaaagcugcaucaauaggugcuuuuacguggaguugauaaggggaagggaacaggagacuagaguaugguggaccucaaacaguauuguuguguuuuguggcacuucagguaccuaugggacaggcucauggccugauggggcggacaucaaucucaugccuauauaa

SEQ ID NO: 44620 - RNA, 1410 nt, Artificial Sequence
  neuraminidase__InfluenzaA__AAO46486
augaauccaaaucaaaagauaauaacgauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacaggaauuggucaaaaccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauugaugaaugaguuggguguuccauuucauuugggaaccaggcaaguguguauagcaugguccagcucaaguugucacgauggaaaagcauggcugcauguuugugucacuggggaugauaaaaaugcaacugcuagcuucauuuacgaugggaggcuuguggacaguauugguucauggucucaaaauauucucaggacccaggagucggaaugcguuuguaucaaugggacuuguacaguaguaaugacugauggaagugcuucaggaagagcugauacuagaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaauagcuauugccggaauccuaacaaugagagaggaaaucacggagugaaaggcugggccuuugacgauggaaaugacguguggaugggaagaacgaucagcaaggauucacgcucagguuaugaaaccuucaaagucauuggugguugguccacaccuaauuccaaaucgcagauaaauaggcaagucauaguugacagcgauaauaggucagguuauucugggauuuucucuguugagggcaaaagcugcaucaauaggugcuuuuauguggaguugauaaggggaagggaacaggagacuagaguaugguggaccucaaacaguauuguuguguuuuguggcacuucagguaccuaugggacaggcucauggccugauggggcggacaucaaucucaugccuauauaa

SEQ ID NO: 44621 - RNA, 1410 nt, Artificial Sequence
  neuraminidase__InfluenzaA__AAO46489
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagaaauaguguauuugacuaacaccaccauagagaaagagauaugccccaaauuaguggaauacaggaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuaaacaacaaacauucaaaugacacaauacaugauagaaucccucaucgaacccuauugaugaaugaguuggguguuccauuucauuugggaaccaggcaaguguguauagcaugguccagcucaaguugucacgauggaaaagcauggcugcauguuugugucacuggggaugauaaaaaugcaacugcuagcuucauuuacgaugggaggcuuguggacaguauugguucauggucucaaaauauccucaggacccaggagucggaaugcguuuguaucaaugggacuuguacaguaguaaugacugauggaagugcuucaggaaaagcugauacuagaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaguagcuauugccggaauccuaacaaugagagagggaaucacggagugaaaggcugggccuuugacgauggaaaugacguguggaugggaagaacgaucagcaaggauucacgcucagguuaugaaaccuucaaagucauuggugguugguccacaccuaauuccaaaucgcagauaaauaggcaagucauaguugacagcgauaauaggucagguuauucugguauuuucucuguugagggcaaaagcugcaucaauaggugcuuuuacguggaguugauaaggggaagggaacaggagacuagaguaugguggaccucaaacaguauuguuguguuuuguggcacuucagguaccuaugggacaggcucauggccugauggggcggacaucaaucucaugccuauauaa

SEQ ID NO: 44622 - RNA, 1410 nt, Artificial Sequence
  neuraminidase__InfluenzaA__AAO46491
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacaggaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaauuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauccucaggacccaggagucggaaugcguuuguaucaaugggacuuguacaguaguaaugacugauggaagugcuucaggaagagcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaauagcuauugccggaauccuaacaaugagaaagggaaucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 44623 - RNA, 1410 nt, Artificial Sequence; identical to SEQ ID NO: 44622
  neuraminidase__InfluenzaA__AAO46492

SEQ ID NO: 44624 - RNA, 1410 nt, Artificial Sequence
  neuraminidase__InfluenzaA__AAO88264
augaauacaaaucaaagaauaauaaccauugggacagucugucugauagucggaauaguuagucuauuauugcagauaggaaauauagucucguuauggauaagccauucaauucagacuggaaagaaaaacuacucuaagauaugcaguaaaagugucauuacauaugaaaacaacacaugggugaaccaaacuuauguaaacauuagcaauaucaacauugcugauggacagggaguaaauucaauaauacuagccggcaauuccucucuuugcccaauaaguggaugggcuauauacagcaaagacaauagcauaaggaucgguuccaaaggagacauuuuugucauaagagaaccauucauuucaugcucucauuuggagugcaggaccuuuuuucugacccaaggugcuuugcugaaugacaggcauucuaauggaaccgucaaagacaggaguccuuauaggaccuuaaugaguugcccgauuggugaagcuccaucuccguacaauucaagguucgaaucaguugcuuggucagcaagugcaugccaugauggaaugggauggcuaacaaucgggauuuccgguccagauaauggagcaguggcuguuuugaaguacaaugggauaauaacagauacaauaaaaaguuggaggaacaaaauacuaagaacacaagagucagaaugugucuguaucaacgguucauguuuuacuauaaugacugauggcccaagcaaugggcaggccucauacaaaauauucaaaauggagaaaggaaagauuauuaaaucaguugagcuggaugcaccuaauuaccacuaugaggaaugcuccuguuacccugauacaggcaaaguggugugcgugugcagcgacaauuggcaugcuucgaaucgaccaugggucucuuucgaucagaaucuugauuaucagauaggguacauaugcagugggguuuuuggugauaacccgcguucuaaugaugggagaggcaauuguggcccagugcuuucuaauggagcgaauggagugaaaggauucucauuuagauauggcaauggugucuggauaggaagaacuaaaaguaucagcucuagaaguggauuugagaugauuugggauccaaauggauggacggaaacugauaguaguuucucuauaaagcaggauguuauagcauuaacugauuggucaggauacagugggagcuuuguccaacaucccgaauuaacaggaaugaacugcauaaggccuuguuucuggguagaguuaaucagaggacaacccaaggagagcacaaucuggacuaguggaagcagcauuucuuucuguggcguagacagugaaaccgcaagcuggucauggccagacggagcugaucugccauucacuauugacaaguag

SEQ ID NO: 44625 - RNA, 1410 nt, Artificial Sequence
  neuraminidase__InfluenzaA__AAQ10334
augaauccaaaucaaaagauaauaacaauuggcucuguuucucucacuauugccacaauaugcuuccuuaugcaaauugccauccugguaacuacuguaacauugcauuucaagcaauaugaaugcaacccccccccaaacaaccaaguaaugcugugugaaccaacaauaauagaaagaaacauaacagagauaguguaucugaccaacaccaccauagagaaagagauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcuagcuucauuuacaaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccugaauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44626 - RNA, 1410 nt, Artificial Sequence; identical to SEQ ID NO: 44625
  neuraminidase__InfluenzaA__AAQ10335

SEQ ID NO: 44627 - RNA, 1410 nt, Artificial Sequence
  neuraminidase__InfluenzaA__AAQ10336
augaauccaaaucaaaagauaauaacaauuggcucuguuucucucacuauugccacaauaugcuuccuuaugcaaauugccauccugguaacuacuguaacauugcauuucaagcaauaugaaugcaacccccccccaaacaaccaaguaaugcugugugaaccaacaauaauagaaagaaacauaacagagauaguguaucugaccaacaccaccauagagaaagagauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcuagcuucauuuacaaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccugaauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggaaaucaaucucaugccuauauaa

SEQ ID NO: 44628 - RNA, 1410 nt, Artificial Sequence; identical to SEQ ID NO: 44625
  neuraminidase__InfluenzaA__AAQ10337

SEQ ID NO: 44629 - RNA, 1410 nt, Artificial Sequence
  neuraminidase__InfluenzaA__AAQ10339
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagcccauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagacguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44630 - RNA, 1410 nt, Artificial Sequence
  neuraminidase__InfluenzaA__AAQ10341
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacagaugggagugcuucaggaagagcugauacuaaaauacuauucauugaggaggggaaaaucguucauauuagcccauugucaggaagugcucagcaugucgaggagugcuccuguuauccucgguauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44631 - RNA, 1410 nt, Artificial Sequence
  neuraminidase__InfluenzaA__AAQ10343
augaauccaaaucaaaagauaauaacgauuggcucuguuucucucacuauugccacaauaugcuuccuuaugcaaauugccauccugguaacuacuguaacauugcauuucaagcaauaugaaugcagcucucccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagggaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauaucagcccacugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagucauugccugaauccuaacaaugaggaagggggucauggagugaaaggcugggccuuugaugauggaaaugacguguggaugggaagaacaaucagcgagaaguuccgcucagguuaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguugcguuuuguggcaccucagguacauauggaacaggcucauggccugauggggcggacaucaaucucaugccuauauaa

SEQ ID NO: 44632 - RNA, 1191 nt, Artificial Sequence
  neuraminidase__InfluenzaA__AAQ10344
augaauccaaaucaaaagauaauaacgauuggcucuguuucucucacuauugccacaauaugcuuccuuaugcaaauagccauccugguaacuacuguaacauugcauuucaagcaauaugaaugcaacucccccccaaacaaccaagcaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggauaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguugggugucccauuucauuugggaaccaagcaaguguguauagcaugguccagcucaaguugucacgauggaaaagcauggcugcauguuuguguaacugggcaugaugaaaaugcaacugcuagcuucauuuacgaugggagacuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauacuagcaaauugucaggaagugcucagcaugucgaggagugcuccuguuauccccgauauccuggugucagaugugucugcagagacaacuggaaaggcuccaauaggcccaucguagauauaaauguaaaggauuauagcauuguuuccaguuaugugugcucaggacuuguuggagauacacccagaaaaaacgacagcuccagcaguagucauugccugaauccuaacaaugaggaagggggucauggagugaaaggcugggccuuugaugauggaaaugacguguggaugggaagaacgaucagcgagaaguuccgcucagguuaugaaaccuucaaagucauugaaggcugguccaaaccuaacuccaaauugcagauaaauagcaagucauag

SEQ ID NO: 44633 - RNA, 1416 nt, Artificial Sequence
  neuraminidase__InfluenzaA__AAR11366
augaauccaaaucagaaacuauuugcauuaucuggaguggcaauagcacuuaguguacugaacuuauugauaggaaucucaaacgucggauugaacguaucucuacaucuaaaggaaaaaggacccaaacaggaggagaauuuaacaugcacgaccauuaaucaaaacaacacuacuguaguagaaaacacauacguaaauaauacaacaauaauuaccaagggaacugauuugaaaacaccaagcuaucugcuguugaacaagagccugugcaauguugaagggugggucgugauagcaaaagacaaugcaguaagauuuggggaaagugaacaaaucauuguuaccagggagccauauguaucaugcgacccaacaggaugcaaaauguaugccuugcaccaagggacuaccauuaggaacaaacauucaaauggaacgauucaugacagaacagcuuucagaggucucaucuccacuccauugggcacuccaccaaccguaaguaacagugacuuuauguguguuggauggucaagcacaacuugccaugaugggauugcuaggaugacuaucuguauacaaggaaauaaugacaaugcuacagcaacgguuuauuacaacagaaggcugaccacuaccauuaagaccugggccagaaacauucugaggacucaagaaucagaaugugugugccacaauggcacaugugcaguuguaaugaccgacggaucggcuaguagucaagccuauacaaaaguaauguauuuccacaagggauuaguaguuaaggaggaggaguuaaggggaucagccagacauauugaggaaugcuccuguuauggacacaaucaaaaggugaccugugugugcagagauaacuggcagggagcaaacaggccuauuauagaaauugauaugaacacauuggagcacacaaguagauacgugugcacuggaauucucacagacaccagcagaccuggggacaaaucuaguggugauuguuccaauccaauaacugggagucccggcgcuccgggagugaagggauucggguuucuaaauggggauaacacauggcuugguaggaccaucagccccagaucaagaaguggauucgaaauguugaaaauaccuaaugcagguacugaucccaauucuagaauagcagaacgacaggaaauugucgacaauaacaauuggucaggcuauuccggaagcuuuauugacuauuggaaugauaacagugaaugcuacaauccaugcuuuuacguagaguuaauuagaggaagacccgaagaggcuaaauacguaugguggacaaguaacagucuaauugcccuauguggaagcccauucccaguugggccugguuccuuccccgauggggcacaaauccaauacuuuucguaa

SEQ ID NO: 44634 - RNA, 1350 nt, Artificial Sequence
  neuraminidase__InfluenzaA__AAS89005
augaauccaaauaagaagauaauaaccaucggaucaaucuguaugguaacuggaaugguuagcuuaauguuacaaauugggaacuugaucucaauaugggucagucauucaauucacacagggaaucaacagaaagcugaaccaauuagcaauacuaauuuucuuacugagaaagcuguggcuucaguaaaauuagcgggcaauucaucucuuugcccuauuaauggaugggcuguauacaguaaggacaacaguauaaggaucgguuccaagggggauguguuuguuauaagagagccauucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaguggggcuguggcuguauugaaauacaauggcauaauaacagacacuaucaagaguuggaggaauaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaacaaaaagcacuaauuccaggagcggcuuugaaaugauuugggauccaaauggguggauugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 44635 - RNA, 1350 nt, Artificial Sequence
  neuraminidase__InfluenzaA__AAS89006
augaauccaaauaagaagauaauaaccaucggaucaaucuguaugguaacuggaaugguuagcuuaauguuacaaauugggaacuugaucucaauaugggucagucauucaauucacacagggaaucaacacaaagcugaaccaaucagcaauacuaauuuucuuacugagaaagcuguggcuucaguaaaauuagcgggcaauucaucucuuugccccauuaauggaugggcuguauacaguaaggacaacaguauaaggaucgguuccaagggggauguguuuguuauaagagagccauucaucucaugcucccacuuggaaugcagaacuuucuuuuugacucagggagccuugcugaaugacaagcacuccaaugggaccgucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaauaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaacaaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 44636 - RNA, 1410 nt, Artificial Sequence
  neuraminidase__InfluenzaA__AAT38822
augaauccgaaucagaagauaauaacaaucgggguagugaauaccacucugucaacaauagcccuuuucauuggagugggaaacuuaguuuucaacacagucauacaugagaaaauaggagaccaucaaauagugacccauccaacaauaaugaccccugaaguaccgaacugcagugacacuauaauaacauacaauaacacuguuauaaacaacauaacaacaacaauaauaacugaagcagaaaggccuuucaagucuccacuaccgcugugccccuucagaggauucuucccuuuucacaaggacaaugcaauacgacugggugaaaacaaagacgucauagucacaagggagccuuauguuagcugcgauaaugacaacugcugguccuuugcucucgcacaaggagcauugcuagggacuaaacauagcaaugggaccauuaaagacagaacaccauauaggucucuaauucguuucccaauaggaacagcuccaguacuaggaaauuacaaagagauaugcauugcuuggucgagcagcaguugcuuugacgggaaagaguggaugcaugugugcaugacagggaaugauaaugaugcaagugcccagauaauauauggaggacgaaugacagacuccauuaaaucauggaggaaggacauacuaagaacccaggagucugaaugucaaugcauugacgggacuuguguuguugcugucacagauggcccugcugcuaauagugcagaucacaggguuuacuggauacgggagggaagaauaauaaaguaugaaaauguucccaaaacaaagauacaacacuuagaagaauguuccugcuauguggacauugauguuuacuguauauguagggacaauuggaagggcucuaacagaccuuggaugagaaucaacaacgagacuauacuggaaacaggauauguauguaguaaauuucacucagacacccccaggccagcugacccuucaauaaugucaugugacuccccaagcaaugucaauggaggacccggagugaagggguuugguuucaaagcuggcaaugauguaugguuagguagaacagugucaacuagugguagaucgggcuuugaaauuaucaaaguuacagaaggguggaucaacucuccuaaccaugucaaaucaauuacacaaacacuaguguccaacaaugacuggucaggcuauucagguagcuucauugucaaagccaaggacuguuuucagcccuguuuuuauguugagcuuauacgagggaggcccaacaagaaugaugacgucucuuggacaaguaauaguauaguuacuuucuguggacuagacaaugaaccuggaucgggaaauuggccagaugguucuaacauuggguuuaugcccaaguaa

SEQ ID NO: 44637 - RNA, 1350 nt, Artificial Sequence
  neuraminidase__InfluenzaA__AAV65827
augaauccaaauaagaagauaauaaccaucggaucaaucuguaugguaacuggaaugguuagcuuaauguuacaaauugggaacuugaucucaauaugggucagucauucaauucacacagggaaucaacacaaagcugaaccaaucagcaauacuaauuuucuuacugagaaagcuguggcuucaguaaaauuagcgggcaauucaucucuuugccccauuaauggaugggcuguauacaguaaggacaacaguauaaggaucgguuccaagggggauguguuuguuauaagagagccauucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaauaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaacaaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 44638 - RNA, 1410 nt, Artificial Sequence
  neuraminidase__InfluenzaA__AAX11488
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucagaaugcguuuguaucaauggaacuuguacagugguaaugacugauggaagcgcuucaggaaaagcugauacuaaaauacuauucauugaggaggggaaaaucguucauauuagcgcauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44639 - RNA, 1410 nt, Artificial Sequence
  neuraminidase__InfluenzaA__AAX11508
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccacuauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaauaacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44640 - RNA, 1410 nt, Artificial Sequence
  neuraminidase__InfluenzaA__AAX11538
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggugacaucugggugacaagagaaccuuaugugucaugcgauccugacaaguguuaucaauuugcccuugggcagggaacaacacuaaacaacgggcauucaaaugacacaguacaugagaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaaugggacuuguacaguaguaaugacugaugggagcgcuucaggaaaagcugauacuaaaauacuauucauugaggaggggaaaaucguucauauuagcacauugucaggaagugcucagcaugucgaggaauguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 44641 - RNA, 1410 nt, Artificial Sequence
  neuraminidase__InfluenzaA__AAX11548
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggugacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaguguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 44642 - RNA, 1410 nt, Artificial Sequence; identical to SEQ ID NO: 44639
  neuraminidase__InfluenzaA__AAX11558

SEQ ID NO: 44643 - RNA, 1410 nt, Artificial Sequence
  neuraminidase__InfluenzaA__AAX11568
augaauccaaaucaaaagauaauaacaauuggcucuguuucucucaccauugccacaauaugcuuccuuaugcaaauugccaucuugguaacuacuguaacauugcauuucaagcagcaugaaugcuacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucuggcauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 44644 - RNA, 1410 nt, Artificial Sequence
  neuraminidase__InfluenzaA__AAX11578
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaauaacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44645 - RNA, 1410 nt, Artificial Sequence
  neuraminidase__InfluenzaA__AAX11588
augaauccaaaucaaaagauaauaacaauuggcucuguuucucucaccauugccgcaauaugcuuccuuaugcaaauugccauccugguaaccacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcauuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagagaaaacugaagucugguggaccucaaacaguauuguuguguuuuguggcaccucagguacauauggaacaggcucauggccugauggggcggauaucaaucucaugccuauauaa

SEQ ID NO: 44646 - RNA, 1410 nt, Artificial Sequence
  neuraminidase__InfluenzaA__AAX11598
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggugacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugccagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaguguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 44647 - RNA, 1410 nt, Artificial Sequence
  neuraminidase__InfluenzaA__AAX11608
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugucccaaacuagcagaauacagaaauuggucaaagccgcaauguaacauuacaggauuugcaccuuuuucuaaggacaauucgauucggcuuuccgcugguggugacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugccagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaauguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 44648 - RNA, 1410 nt, Artificial Sequence
  neuraminidase__InfluenzaA__AAX11618
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggugacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcgcauugucaggaagugcucagcaugucgaggaguguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 44649 - RNA, 1410 nt, Artificial Sequence
  neuraminidase__InfluenzaA__AAX12744
augaauccaaaucaaaagauaauaacaauuggcucuguuucucucaccauugccacaauaugcuuccuuaugcaaauugccaucuugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacaaucagcgagaaguuacgcucagguuaugaaaccuucaaagucaucgaaggcugguccaaaccuaacuccaaauuacagauaaauaggcaaguuauaguugaaagagguaacagguccgguuauucuggcauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 44650 - RNA, 1410 nt, Artificial Sequence; identical to SEQ ID NO: 44641
  neuraminidase__InfluenzaA__AAX12754

SEQ ID NO: 44651 - RNA, 1410 nt, Artificial Sequence
  neuraminidase__InfluenzaA__AAX12774
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagagaaggaaauaugccccaaauuagcagaauacagaaauuggucaaagccgcaauguaacauuacaggauuugcaccuuuuuccaaggacaauucgauucggcuuuccgcugguggggacaucugggugacaagagaaccuuauguuucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguuaauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaaguuugguggaccucaaacaguauuguuguguuuuguggcaccucagguacauauggaacaggcucauggccugauggggcggauaucaaucucaugccuauauaa

SEQ ID NO: 44652 - RNA, 1410 nt, Artificial Sequence
  neuraminidase__InfluenzaA__AAX12804
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacaacuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44653 - RNA, 1410 nt, Artificial Sequence
  neuraminidase__InfluenzaA__AAX12814
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagagaaggaaauaugccccaaauuagcagaauacagaaauuggucaaagccgcaauguaacauuacaggauuugcaccuuuuuccaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggaaucggaaugcguuuguaucaauggaacuuguacaguaguaaugacugauggaagcgcuucaggaaaagcugauacuaaaauacuauucauugaggaggggaaaaucguuaauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaauagguccgguuauucugguauuuucuccguugaaggcaaaagcugcaucaaucggugcuuuuauguggaguugauaaggggaaggaaagaggaaacugaaguuugguggaccucaaacaguauuguuguguuuuguggcaccucagguacauauggaacaggcucauggccugauggggcggauaucaaucucaugccuauauaa

SEQ ID NO: 44654 - RNA, 1410 nt, Artificial Sequence
  neuraminidase__InfluenzaA__AAX34064
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagagggaaauaugccccaaacuagcagaauacagaaauuggucaaagccgcaauguaacauuacaggauuugcaccuuuuucuaaggacaauucgauucgacuuuccgcugguggugacaucugggugacaagagaaccuuaugugucaugcgauccugacaaguguuaucaauuugcccuugggcagggaacaacacuaaacaacgggcauucaaaugacacaguacaugauaggaccccuuaucggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaguguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 44655 - RNA, 1410 nt, Artificial Sequence
  neuraminidase__InfluenzaA__AAX35824
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucuggccaauaccacuauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagagcccuaugugucaugcgauccugacaaguguuaucaauuugcccuugggcagggaacaacacuaaacaacggacauucaaaugacacaguacaugauaggaccccuuaccggacccuauugaugaaugaauuggguguuccauuucauuugggaaccaggcaaguguguauagcaugguccagcucaaguugucacgauggaaaagcauggcugcauguuuguguaacuggggaugauaaaaaugcaacugcuaguuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucauucauauuagcacauugucaggaagugcucagcaugucgaggagugcuccuguuauccucgauauccuggugucagauguguaugccgagacaacuggaaaggcuccaauaggcccaucguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44656 - RNA, 1410 nt, Artificial Sequence; identical to SEQ ID NO: 44639
  neuraminidase__InfluenzaA__AAX35834

SEQ ID NO: 44657 - RNA, 1410 nt, Artificial Sequence
  neuraminidase__InfluenzaA__AAX35844
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcccagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaauagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguucaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44658 - RNA, 1410 nt, Artificial Sequence
  neuraminidase__InfluenzaA__AAX35854
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucacuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44659 - RNA, 1410 nt, Artificial Sequence
  neuraminidase__InfluenzaA__AAX35864
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagagaaggaaauaugccccaaauuagcagaauacagaaauuggucaaagccgcaauguaacauuacaggauuugcaccuuuuuccaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaauauacucagaacccaggagucggaaugcguuuguaucaauggaacuuguacaguaguaaugacugaugggagcgcuucaggaaaagcugauacuaaaauacuauucauugaggaggggaaaaucguuaauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaaguuugguggaccucaaacaguauuguuguguuuuguggcaccucagguacauauggaacaggcucauggccugauggggcggauaucaaucucaugccuauauaa

SEQ ID NO: 44660 - RNA, 1410 nt, Artificial Sequence
  neuraminidase__InfluenzaA__AAX47538
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagaggaggaaauaugccccaaauuagcagaauacagaaauuggucaaagccgcaauguaacauuacaggauuugcaccuuuuuccaaggacaauucgauucggcuuuccgcugguggggacaucugggugacaagagaaccuuauguuucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaauggaaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguuaauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaaguuugguggaccucaaacaguauuguuguguuuuguggcaccucagguacauauggaacaggcucauggccugauggggcggauaucaaucucaugccuauauaa

SEQ ID NO: 44661 - RNA, 1410 nt, Artificial Sequence; identical to SEQ ID NO: 44644
  neuraminidase__InfluenzaA__AAX56383

SEQ ID NO: 44662 - RNA, 1410 nt, Artificial Sequence
  neuraminidase__InfluenzaA__AAX56393
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccacuauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggaagggaacaacacuaaacaacgggcauucaaauaacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44663 - RNA, 1410 nt, Artificial Sequence; identical to SEQ ID NO: 44644
  neuraminidase__InfluenzaA__AAX56413

SEQ ID NO: 44664 - RNA, 1410 nt, Artificial Sequence
  neuraminidase__InfluenzaA__AAX56423
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccacaauguaacauuacaggauuugcaccuuuuucuaaggacaauucgauucggcuuuccgcugguggugacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaguguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 44665 - RNA, 1410 nt, Artificial Sequence; identical to SEQ ID NO: 44639
  neuraminidase__InfluenzaA__AAX56433

SEQ ID NO: 44666 - RNA, 1410 nt, Artificial Sequence
  neuraminidase__InfluenzaA__AAX56443
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucaugauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44667 - RNA, 1410 nt, Artificial Sequence
  neuraminidase__InfluenzaA__AAX56473
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaccugaccaacaccaccauagagaaggaaauaugccccaaacuagcagaauacagaaauuggucaaagccgcaguguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaagaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaaacugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44668 - RNA, 1410 nt, Artificial Sequence
  neuraminidase__InfluenzaA__AAX56483
augaauccaaaucaaaagauaauaacaauuggcucuguuucucucaccauugccacaauaugcuuccuuaugcaaauugccauccugguaacuacuguaacauugcauuucaagcaguaugaaugugacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacggacauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44669 - RNA, 1410 nt, Artificial Sequence
  neuraminidase__InfluenzaA__AAX56503
augaauccaaaucaaaagauaauaacaauuggcucuguuucucucaccauugccacaauaugcuuccuuaugcaaauugccauccugguaacuacuguaacauugcauuucaagcaguaugaaugugacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44670 - RNA, 1410 nt, Artificial Sequence
  neuraminidase__InfluenzaA__AAX56513
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44671 - RNA, 1413 nt, Artificial Sequence
  neuraminidase__InfluenzaA__AAX56533
augaauccaaaucaaaaaauaauaaccauuggaucaaucaguguggcaaucggaauaauuagucuaauauugcaaauaggaaauauuauuucaauaugggcuagccacucaauccaaacuggaagucaaaacuacacuggaauaugcaaccaaagaaucauuacauaugaaaauagaaccuggguaaaucaaacauauguuaauauuaacaacacuaauguuguugcuggaaaggacaaaaccucgaugacauuggccggcaauucaucucuuugcccuauccguggaugggcaauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccauuaaggacagaagcccuuuuagggccuuaaugagcuguccucugggugaagcuccgucuccauacaauucaagauuugaaucaguugcuuggucagcaagcgcaugccaugauggccugggcuggcuaacaaucggaauuucugguccagauaauggagcaguggcuguacuaaaauacaacggcauaauaacugaaaccauaaaaaguuggaaaaagcaaauccuaagaacacaagagucugaaugugucugugugaacgguucauguuuuaccauaaugaccgauggcccgaguaacagggccgcaucguacagaaucuucaaaauugagaaggggagaguuacuaaaucaauagaguuggaugcacccaauuaucauuacgaggaauguuccuguuauccagacaccggcacaguaaugugugugugcagggacaauuggcacgguucaaaucgaccuuggguguccuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacuaagaaagggauuugagaugauuugggauccuaauggauggacagauaccgacagugauuucucaaugaaacaggaugucguggcaaugaaugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcgugaauagcgagacugcaaacuggucuuggccagacggugcugaguugccauucaccauugacaaguag

SEQ ID NO: 44672 - RNA, 1410 nt, Artificial Sequence
  neuraminidase__InfluenzaA__AAX56543
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcuaguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgaggaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44673 - RNA, 1410 nt, Artificial Sequence
  neuraminidase__InfluenzaA__AAX56553
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44674 - RNA, 1410 nt, Artificial Sequence
  neuraminidase__InfluenzaA__AAX56563
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaccugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucagaaugcguuuguaucaauggaacuuguacagugguaaugacugauggaagcgcuucaggaaaagcugauacuaaaauacuauucauugaggaggggaaaaucguucauauuagcgcauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagauaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44675 - RNA, 1410 nt, Artificial Sequence
  neuraminidase__InfluenzaA__AAX56573
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagauaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44676 - RNA, 1410 nt, Artificial Sequence
  neuraminidase__InfluenzaA__AAX56583
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacgggauuugcaccuuuuucuaaggacaauucgauucggcuuuccgcugguggggacaucugggugacaagagaaccuuauguaucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagaccacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44677 - RNA, 1410 nt, Artificial Sequence
  neuraminidase__InfluenzaA__AAX56593
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagagaaggaaauaugccccaaauuagcagaauacagaaauuggucaaagccgcaauguaacauuacaggauuugcaccuuuuuccaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguuaauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggaugggccuuugaugauggaaaugacguguggaugggaagaacgaucagcgagaaguuucgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaaguuugguggaccucaaacaguauuguuguguuuuguggcaccucagguacauauggaacaggcucauggccugauggggcggauaucaaucucaugccuauauaa

SEQ ID NO: 44678 - RNA, 1410 nt, Artificial Sequence
  neuraminidase__InfluenzaA__AAX56603
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacagcacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44679 - RNA, 1410 nt, Artificial Sequence
  neuraminidase__InfluenzaA__AAX57647
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugauaaguguuaucaauuugcccuugggcagggaacaacacuaaacaacgggcauucaaaugacacaguacaugauaggaccccuuaccggacccuguugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44680 - RNA, 1410 nt, Artificial Sequence; identical to SEQ ID NO: 44639
  neuraminidase__InfluenzaA__AAX57657

SEQ ID NO: 44681 - RNA, 1410 nt, Artificial Sequence; identical to SEQ ID NO: 44677
  neuraminidase__InfluenzaA__AAX57667

SEQ ID NO: 44682 - RNA, 1410 nt, Artificial Sequence; identical to SEQ ID NO: 44666
  neuraminidase__InfluenzaA__AAX57677

SEQ ID NO: 44683 - RNA, 1410 nt, Artificial Sequence
  neuraminidase__InfluenzaA__AAX57687
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagagaaggaaauaugccccaaauuagcagaauacagaaauuggucaaagccgcaauguaacauuacaggauuugcaccuuuuuccaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacgaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguuaauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaaguuugguggaccucaaacaguauuguuguguuuuguggcaccucagguacauauggaacaggcucauggccugauggggcggauaucaaucucaugccuauauaa

SEQ ID NO: 44684 - RNA, 1410 nt, Artificial Sequence
  neuraminidase__InfluenzaA__AAX57697
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggaucauagcauuguuuccaguuaugugugcucaggacuuguuggagacacacccagaaaaaacgacagcuucagcaguagccauugccuagacccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44685 - RNA, 1410 nt, Artificial Sequence
  neuraminidase__InfluenzaA__AAX57707
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagauucagcaguagccauugccuagauccuaacaaugaggaagguggucauggggugaaaggcugggccuuugaugauggaaaugauguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44686 - RNA, 1410 nt, Artificial Sequence
  neuraminidase__InfluenzaA__AAX57717
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44687 - RNA, 1410 nt, Artificial Sequence; identical to SEQ ID NO: 44677
  neuraminidase__InfluenzaA__AAX57726

SEQ ID NO: 44688 - RNA, 1410 nt, Artificial Sequence
  neuraminidase__InfluenzaA__AAX57737
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagagaaggaaauaugccccaaauuagcagaauacagaaauuggucaaagccgcaauguaacauuacaggauuugcaccuuuuuccaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguuaauauuagcacauugucaggaagugcucagcaugucgaggaaugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggaugggccuuugaugauggaaaugacguguggaugggaagaacgaucagcgagaaguuucgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaaguuugguggaccucaaacaguauuguuguguuuuguggcaccucagguacauauggaacaggcucauggccugauggggcggauaucaaucucaugccuauauaa

SEQ ID NO: 44689 - RNA, 1410 nt, Artificial Sequence; identical to SEQ ID NO: 44673
  neuraminidase__InfluenzaA__AAX57747

SEQ ID NO: 44690 - RNA, 1410 nt, Artificial Sequence
  neuraminidase__InfluenzaA__AAX57757
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuucgaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44691 - RNA, 1410 nt, Artificial Sequence
  neuraminidase__InfluenzaA__AAX57767
augaauccaaaucaaaagauaauaacgauuggcucuguuucucucaccauugccacaauaugcuuccuuaugcaaauugccauccugguaacuacuguaacauugcauuucaagcaauaugaaugcaacccccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaauggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44692 - RNA, 1410 nt, Artificial Sequence
  neuraminidase__InfluenzaA__AAX57777
augaauccaaaucaaaagauaauaacgauuggcucuguuucucucaucauugcuacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacaaggaacaacacuaaacaacgggcauucaaaugacacaguacaugauaggaccccuuaucgaacccuauugaugaaugaguuggguguuccauuucauuugggaaccaaacaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44693 - RNA, 1410 nt, Artificial Sequence
  neuraminidase__InfluenzaA__AAX57787
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagagaaggaaauaugccccaaauuagcagaauacagaaauuggucaaagccgcaauguaacauuacaggauuugcaccuuuuuccaaggacaauucgauucggcuuuccgcugguggggacaucugggugacaagagaaccuuaugugucaugcgauccugacaagugcuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcuaauacuaaaauacuauucauugaggaggggaaaaucguuaauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggaugggccuuugaugauggaaaugacguguggaugggaagaacgaucagcgagaaguuucgcucagguuaugaaaccuucaaagucaucgaagguugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaaguuugguggaccucaaacaguauuguuguguuuuguggcaccucagguacauauggaacaggcucauggccugauggggcggauaucaaucucaugccuauauaa

SEQ ID NO: 44694 - RNA, 1410 nt, Artificial Sequence; identical to SEQ ID NO: 44673
  neuraminidase__InfluenzaA__AAX57797

SEQ ID NO: 44695 - RNA, 1410 nt, Artificial Sequence; identical to SEQ ID NO: 44673
  neuraminidase__InfluenzaA__AAX57807

SEQ ID NO: 44696 - RNA, 1410 nt, Artificial Sequence
  neuraminidase__InfluenzaA__AAX57817
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauuaguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44697 - RNA, 1410 nt, Artificial Sequence
  neuraminidase__InfluenzaA__AAX57837
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcacgucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44698 - RNA, 1410 nt, Artificial Sequence
  neuraminidase__InfluenzaA__AAX57847
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggaaucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugauagagguaauagguccgguuauucugguauuuucucuguugaaagcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44699 - RNA, 1410 nt, Artificial Sequence
  neuraminidase__InfluenzaA__AAX57857
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaacaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44700 - RNA, 1410 nt, Artificial Sequence; identical to SEQ ID NO: 44673
  neuraminidase__InfluenzaA__AAX57867

SEQ ID NO: 44701 - RNA, 1410 nt, Artificial Sequence
  neuraminidase__InfluenzaA__AAX57877
augaauccaaaucaaaagauaauaacgauuggcucuguuucucucaccauugcuacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacaaggaacaacacuaaacaacgggcauucaaaugacacaguacaugauaggaccccuuaucgaacccuauugaugaaugaguuggguguuccauuucauuugggaaccaaacaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugcauauauaa

SEQ ID NO: 44702 - RNA, 1410 nt, Artificial Sequence
  neuraminidase__InfluenzaA__AAX57887
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcaucguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaauugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44703 - RNA, 1410 nt, Artificial Sequence
  neuraminidase__InfluenzaA__AAX57897
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauagaaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcauguugaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugauaguggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44704 - RNA, 1410 nt, Artificial Sequence
  neuraminidase__InfluenzaA__AAX57907
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagaugaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44705 - RNA, 1410 nt, Artificial Sequence; identical to SEQ ID NO: 44673
  neuraminidase__InfluenzaA__AAX57917

SEQ ID NO: 44706 - RNA, 1410 nt, Artificial Sequence; identical to SEQ ID NO: 44673
  neuraminidase__InfluenzaA__AAX57927

SEQ ID NO: 44707 - RNA, 1410 nt, Artificial Sequence
  neuraminidase__InfluenzaA__AAX57937
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagaugguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugcguauauaa

SEQ ID NO: 44708 - RNA, 1410 nt, Artificial Sequence
  neuraminidase__InfluenzaA__AAX57947
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaauaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccagaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauugcuuccaguuauaugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44709 - RNA, 1410 nt, Artificial Sequence
  neuraminidase__InfluenzaA__AAX76626
augaauccaaaucaaaagauaauaacaauuggcucuguuucucucaccauugccacaauaugcuuccuuaugcaaauugccaucuugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucuggcauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 44710 - RNA, 1410 nt, Artificial Sequence
  neuraminidase__InfluenzaA__AAX76646
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaauaacacaguacaugauaggaccccuuaccggacccuauugaugaaugaauuggguguuccauuucauuugggaaccaggcaagugugcauagcaugguccagcucagguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44711 - RNA, 1410 nt, Artificial Sequence; identical to SEQ ID NO: 44644
  neuraminidase__InfluenzaA__AAX76656

SEQ ID NO: 44712 - RNA, 1410 nt, Artificial Sequence; identical to SEQ ID NO: 44684
  neuraminidase__InfluenzaA__AAX76666

SEQ ID NO: 44713 - RNA, 1410 nt, Artificial Sequence; identical to SEQ ID NO: 44673
  neuraminidase__InfluenzaA__AAX76696

SEQ ID NO: 44714 - RNA, 1410 nt, Artificial Sequence
  neuraminidase__InfluenzaA__AAX76736
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuaucagaauacagaaauuggucaaagccgcaauguaacaucacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaguuggguguuccauuucauuugggaaccaagcaagugugcauagcaugguccagcucaaguugucacgauggaaaagcauggcugcauguuuguguaacuggggaugaugaaaaugcaacugcuagcuucauuuauaaugggaggcuuguagauaguauugguucaugguccaaaaaaauacucaggacccaggagucggaaugcguuuguaucaauggaacuuguacaguaguaaugacugaugggagugcuucaggaaaagcugauacuaaaauacuauucauugaggaggggaaaaucguucauauuagcacauugucaagaagugcucagcaugucgaggagugcuccuguuauccucgauauccuggugucagaugugucugcagggacaacuggaaaggcuccaauaggcccaucguagauauaaauguaaaggaccauagcauuguuuccaguuaugugugcucaggacuuguuggagacacacccagaaaaaaugacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauugcagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44715 - RNA, 1410 nt, Artificial Sequence
  neuraminidase__InfluenzaA__AAX76766
augaauccaaaucaaaagauaauaacaauuggcucuguuucucucaccauugccacaauaugcuuccuuaugcaaauugccaucuugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccguugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucuggcauuuucuccguugaaggcaaaagcugcaucaaucggugcuuuuauguggaguugauaaggggaaggaaagaggaaacugaaguuugguggaccucaaacaguauuguuguguuuuguggcaccucagguacauauggaacaggcucauggccugauggggcggacaucaaucucaugccuauauaa

SEQ ID NO: 44716 - RNA, 1410 nt, Artificial Sequence; identical to SEQ ID NO: 44641
  neuraminidase__InfluenzaA__AAY18089

SEQ ID NO: 44717 - RNA, 1410 nt, Artificial Sequence
  neuraminidase__InfluenzaA__AAY18099
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccacuauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaauaacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucguugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggagcggauaucaaucucaugccuauauaa

SEQ ID NO: 44718 - RNA, 1410 nt, Artificial Sequence
  neuraminidase__InfluenzaA__AAY18109
augaauccaaaucaaaagauaauaacaauuggcucuguuucucucaccauugccacaauaugcuuccuuaugcaaauugccauccugguaacuacuuuaacauugcauuucaagcaguaugaaugcaacucccccccaaacaaccaaguaaugcugugugaaccagcaauaauagaaagaaacauaacagagauaguguaucugaccaacaccaccauagagaaggaaaaaugccccaaauuagcagaauacagaaauuggucaaagccgcaauguaacauuacaggauuugcaccuuuuuccaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguuaauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaaguuugguggaccucaaacaguauuguuguguuuuguggcacuucagguacauauggaacaggcucauggccugauggggcagauaucaaucucaugccuauauaa

SEQ ID NO: 44719 - RNA, 1410 nt, Artificial Sequence; identical to SEQ ID NO: 44677
  neuraminidase__InfluenzaA__AAY18119

SEQ ID NO: 44720 - RNA, 1410 nt, Artificial Sequence
  neuraminidase__InfluenzaA__AAY18129
augaauccaaaucaaaagauaauaacaauuggcucuguuucucucaccauugccacaauaugcuuccuuaugcaaauuaccauccugguaacuacuguaacauugcauuucaagcaguaugaaugcaacucccccccaaacaaccaaguaaugcugugugaaccaacaauaauagaaagaaacauaacagagauaguguaucugaccaauaccacuauagaaaaggaaauaugccccaaauuagcagaauacagaaauuggucaaagccgcaauguaacauuacaggauuugcaccuuuuucuaaggacaauucgauucggcuuuccgcugguggggacaucugggugacaagagagccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuaguuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucauucauauuagcacauugucaggaagugcucagcaugucgaggagugcuccuguuauccucgauauccuggugucagauguguaugccgagacaacuggaaaggcuccaauaggcccaucguagauauaaauguaaaggauuauagcauuguuuccaguuaugugugcucaggccuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaucuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44721 - RNA, 1410 nt, Artificial Sequence
  neuraminidase__InfluenzaA__AAY18139
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagagggaaauaugccccaaacuagcagaauacagaaauuggucaaagccgcaauguaacauuacaggauuugcaccuuuuucuaaggacaauucgauucgacuuuccgcugguggugacaucugggugacaagagaaccuuaugugucaugcgauccugacaaguguuaucaauuugcccuugggcagggaacaacacuaaacaacaggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaguguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 44722 - RNA, 1410 nt, Artificial Sequence
  neuraminidase__InfluenzaA__AAY18149
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggugacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugccagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaguguuccuguuauccucgauauccuggugucagaugugucugcagagacaacuggaagggcuccaauaggcccacuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 44723 - RNA, 1410 nt, Artificial Sequence
  neuraminidase__InfluenzaA__AAY18159
augaauccaaaucaaaagauaauaacgauuggcucuguuucucucaucauugcuacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacaaggaacaacacuaaacaacgggcauucaaaugacacaguacaugauaggaccccuuaucgaacccuauugaugaaugaguuggguguuccauuucauuugggaaccaaacaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaaacugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44724 - RNA, 1410 nt, Artificial Sequence
  neuraminidase__InfluenzaA__AAY18179
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaagauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44725 - RNA, 1410 nt, Artificial Sequence
  neuraminidase__InfluenzaA__AAY18189
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggauaucaaucucaugccuauauaa

SEQ ID NO: 44726 - RNA, 1410 nt, Artificial Sequence
  neuraminidase__InfluenzaA__AAY18199
augaauccaaaucaaaagauaauaacgauuggcucuguuucccucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauuaucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccaguaguagccauugcuuggauccaaacaaugaggaagguggucagggagugaaaggcugggccuuugaugauggaaaugacguguggaugggaagaacgaucagcgagaaguuacacucaggauaugaaaccuucaaagucauugaaggcugguccaacccuaacuccaaauugcagauaaauaggcaagucauaguugacagagguaacagguccgguuauucugguauuuucucuguugaaggcaaaagcugcaucaaucggugcuuuuauguggaguugauaaggggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 44727 - RNA, 1410 nt, Artificial Sequence; identical to SEQ ID NO: 44669
  neuraminidase__InfluenzaA__AAY18588

SEQ ID NO: 44728 - RNA, 1410 nt, Artificial Sequence; identical to SEQ ID NO: 44709
  neuraminidase__InfluenzaA__AAY18614

SEQ ID NO: 44729 - RNA, 1410 nt, Artificial Sequence
  neuraminidase__InfluenzaA__AAY27846
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucagaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44730 - RNA, 1410 nt, Artificial Sequence
  neuraminidase__InfluenzaA__AAY27856
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggugacaucugggugacaagagaaccuuaugugucaugcgauccuggcaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucgaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaguguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 44731 - RNA, 1410 nt, Artificial Sequence; identical to SEQ ID NO: 44641
  neuraminidase__InfluenzaA__AAY27866

SEQ ID NO: 44732 - RNA, 1410 nt, Artificial Sequence
  neuraminidase__InfluenzaA__AAY27962
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacaucacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaauaacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44733 - RNA, 1410 nt, Artificial Sequence
  neuraminidase__InfluenzaA__AAY27997
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccacuauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaauaacacaguacaugauaggaccccuuaccggacccuauugaugaaugaaauggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44734 - RNA, 1410 nt, Artificial Sequence; identical to SEQ ID NO: 44639
  neuraminidase__InfluenzaA__AAY28007

SEQ ID NO: 44735 - RNA, 1410 nt, Artificial Sequence
  neuraminidase__InfluenzaA__AAY28017
augaauccaaaucaaaagauaauaacaauuggcucuguuucccucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggaucauagcauuguuuccaguuaugugugcucaggacuuguuggagacacacccagaaaaaacgacagcuucagcaguagccauugccuagacccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44736 - RNA, 1410 nt, Artificial Sequence; identical to SEQ ID NO: 44639
  neuraminidase__InfluenzaA__AAY28268

SEQ ID NO: 44737 - RNA, 1410 nt, Artificial Sequence
  neuraminidase__InfluenzaA__AAY28278
augaauccaaaucaaaagauaauaacgauuggcucuguuucucucacuauugccacaauaugcuuccuuaugcaaauagccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauauagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaccgaacccuauugaugaaugaguuggguguuccauuucauuugggaaccaagcaaguaugcauagcaugguccagcucaaguugucacgauggaaaagcauggcugcauguuuguguaacugggcaugaugaaaaugcaacugcuagcuucauuuacgaugggagacuuguagauaguauugguucaugguccaaaaaaauccucaggacccaggagucggaaugcguuuguaucaauggaacuuguacaguaguaaugacugaugggagugcuucaggaagagcugauaccaaaauacuauucauugaggaggggaaaaucguucauacuagcaaauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccuggauccuaacaaugaagaagggggucauggagugaaaggcugggccuuugaugauggaaaugacguguggaugggaagaacgaucagcgagaagucacgcucagguuaugaaaccuucaaggucauugaaggcugguccaaacccaacuccaaauugcagauaaauaggcaagucauaguugaaagagguaauaggucugguuauucugguauuuucucuguugaaggcaaaagcugcaucaaucggugcuuuuauguggaguugauaaggggaaggaaaccggaaacugaagucugguggaccucaaacaguauuguuguguucuguggcaccucagguacauauggaacaggcucauggccugauggggcggacaucaaucucaugccuauauaa

SEQ ID NO: 44738 - RNA, 1410 nt, Artificial Sequence
  neuraminidase__InfluenzaA__AAY28288
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagagaaggaaauaugccccaaauuagcagaauacagaaauuggucaaagccgcaauguaacauuacaggauuugcaccuuuuuccaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguuaauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaaguuugguggaccucaaacaguauuguuguguuuuguggcaccucagguacauauggaacaggcucauggccugauggggcggauaucaaucucaugccuauauaa

SEQ ID NO: 44739 - RNA, 1410 nt, Artificial Sequence
  neuraminidase__InfluenzaA__AAY28298
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggugacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaguguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccagaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 44740 - RNA, 1410 nt, Artificial Sequence
  neuraminidase__InfluenzaA__AAY28308
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuauguaucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauauuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44741 - RNA, 1410 nt, Artificial Sequence
  neuraminidase__InfluenzaA__AAY28318
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgacggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuugugcaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaacuuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44742 - RNA, 1410 nt, Artificial Sequence
  neuraminidase__InfluenzaA__AAY28338
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagagaaggaaauacgccccaaauuagcagaauacagaaauuggucaaagccgcaauguaacauuacaggauuugcaccuuuuuccaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggaaucggaaugcguuuguaucaauggaacuuguacaguaguaaugacugaugggagcgcuucaggaaaagcugauacuaaaauacuauucauugaggaggggaaaaucguuaauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucauugaaggcugguccaaaccuaacuccaaauuacagauaaauaggcaagucauaguugaaagaggcaacagguccgguuauucugguauuuucuccguugaaggcaaaagcugcaucaaucggugcuuuuauguggaguugauaaggggaaggaaagaggaaacugaaguuugguggaccucaaacaguauuguuguguuuuguggcaccucagguacauauggaacaggcucauggccugauggggcggauaucaaucucaugccuauauaa

SEQ ID NO: 44743 - RNA, 1410 nt, Artificial Sequence; identical to SEQ ID NO: 44709
  neuraminidase__InfluenzaA__AAY28348

SEQ ID NO: 44744 - RNA, 1410 nt, Artificial Sequence; identical to SEQ ID NO: 44673
  neuraminidase__InfluenzaA__AAY28358

SEQ ID NO: 44745 - RNA, 1410 nt, Artificial Sequence; identical to SEQ ID NO: 44709
  neuraminidase__InfluenzaA__AAY28388

SEQ ID NO: 44746 - RNA, 1410 nt, Artificial Sequence
  neuraminidase__InfluenzaA__AAY28398
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagagggaaauaugccccaaacuagcagaauacagaaauuggucaaagccgcaauguaacauuacaggauuugcaccuuuuucuaaggacaauucgauucgacuuuccgcugguggugacaucugggugacaagagaaccuuaugugucaugcgauccugacaaguguuaucaauuugcccuugggcagggaacaacacuaaacaacgggcauucaaaugacacaguacaugauaggaccccuuaccggacccuauuaaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcauguugaggaguguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugacggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 44747 - RNA, 1410 nt, Artificial Sequence; identical to SEQ ID NO: 44669
  neuraminidase__InfluenzaA__AAY28408

SEQ ID NO: 44748 - RNA, 1410 nt, Artificial Sequence; identical to SEQ ID NO: 44646
  neuraminidase__InfluenzaA__AAY28505

SEQ ID NO: 44749 - RNA, 1410 nt, Artificial Sequence
  neuraminidase__InfluenzaA__AAY28524
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggugacaucugggugacaagagaaccuuaugugucaugcgauccugacaaguguuaucaauuugcccuugggcagggaacaacacuaaacaacgggcauucaaauuacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaguguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 44750 - RNA, 1410 nt, Artificial Sequence; identical to SEQ ID NO: 44639
  neuraminidase__InfluenzaA__AAY28534

SEQ ID NO: 44751 - RNA, 1410 nt, Artificial Sequence
  neuraminidase__InfluenzaA__AAY28544
augaauccaaaucaaaagauaauaacaauuggcucuguuucucucaccauugccacaauaugcuuccuuaugcaaauugccaucuugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccuaacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucuggcauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 44752 - RNA, 1410 nt, Artificial Sequence; identical to SEQ ID NO: 44673
  neuraminidase__InfluenzaA__AAY28554

SEQ ID NO: 44753 - RNA, 1410 nt, Artificial Sequence
  neuraminidase__InfluenzaA__AAY28564
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggugacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaguguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccagaccuaacuccaaauuacagauaaauaggcaaguuauaguugaaagagguaacagguccgguuauucugguauuuucuccguugaaagcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 44754 - RNA, 1410 nt, Artificial Sequence
  neuraminidase__InfluenzaA__AAY28574
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaauaacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44755 - RNA, 1410 nt, Artificial Sequence
  neuraminidase__InfluenzaA__AAY28584
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagagaaggaaauaugccccaaauuagcagaauacagaaauuggucaaagccgcaauguaacauuacaggauuugcaccuuuuuccaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguuaauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaauuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaaguuugguggaccucaaacaguauuguuguguuuuguggcaccucagguacauauggaacaggcucauggccugauggggcggauaucaaucucaugccuauauaa

SEQ ID NO: 44756 - RNA, 1410 nt, Artificial Sequence; identical to SEQ ID NO: 44673
  neuraminidase__InfluenzaA__AAY28594

SEQ ID NO: 44757 - RNA, 1410 nt, Artificial Sequence
  neuraminidase__InfluenzaA__AAY28611
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44758 - RNA, 1410 nt, Artificial Sequence
  neuraminidase__InfluenzaA__AAY28651
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucacuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44759 - RNA, 1410 nt, Artificial Sequence
  neuraminidase__InfluenzaA__AAY44613
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaaauagcagaauacagaaauuggucaaagccgcaauguaacauuacaggauuugcaccuuuuucuaaggacaauucgauucggcuuuccgcugguggugacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucugaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaguguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 44760 - RNA, 1410 nt, Artificial Sequence; identical to SEQ ID NO: 44738
  neuraminidase__InfluenzaA__AAY44624

SEQ ID NO: 44761 - RNA, 1410 nt, Artificial Sequence
  neuraminidase__InfluenzaA__AAY44634
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44762 - RNA, 1410 nt, Artificial Sequence
  neuraminidase__InfluenzaA__AAY44644
augaauccaaaucaaaagauaauaacaauuggcucuguuucucucaccauugccacaauaugcuuccuuaugcaaauugccauccugguaacuacuguaacauugcauuucaagcaguaugaaugugacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaagguaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44763 - RNA, 1410 nt, Artificial Sequence
  neuraminidase__InfluenzaA__AAY44654
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauacauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44764 - RNA, 1410 nt, Artificial Sequence
  neuraminidase__InfluenzaA__AAY44758
augaauccaaaucaaaagauaauaacgauuggcucuguuucucucacuauugccacaauaugcuuccuuaugcaaauagccauccugguaacuacuguaacauugcauuucaagcaauaugaaugcaacucccccucaaacaaccaaguaaugcugugugaaccaacaauaauagaaagaaacauaacagagauaguguaucugaccaacaccaccauagagaaggaaauaugccccaaacuagcagaauauagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaccgaacccuauugaugaaugaguuggguguuccauuucauuugggaaccaagcaaguaugcauagcaugguccagcucaaguugucacgauggaaaagcauggcugcauguuuguguaacugggcaugaugaaaaugcaacugcuagcuucauuuacgaugggagacuuguagauaguauugguucaugguccaaaaaaauccucaggacccaggagucggaaugcguuuguaucaauggaacuuguacaguaguaaugacugaugggagugcuucaggaagagcugauaccaaaauacuauucauugaggaggggaaaaucguucauacuagcaaauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccuggauccuaacaaugaagaagggggucauggagugaaaggcugggccuuugaugauggaaaugacguguggaugggaagaacgaucagcgagaagucacgcucagguuaugaaaccuucaaggucauugaaggcugguccaaacccaacuccaaauugcagauaaauaggcaagucauaguugaaagagguaauaggucugguuauucugguauuuucucuguugaaggcaaaagcugcaucaauaggugcuuuuauguggaguugauaaggggaaggaaaccggaaacugaagucugguggaccucaaacaguauuguuguguucuguggcaccucagguacauauggaacaggcucauggccugauggggcggacaucaaucucaugccuauauaa

SEQ ID NO: 44765 - RNA, 1410 nt, Artificial Sequence
  neuraminidase__InfluenzaA__AAY44778
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuguugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44766 - RNA, 1410 nt, Artificial Sequence
  neuraminidase__InfluenzaA__AAY44788
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaagguugggccuuugaugauggaaaugacguguggaugggaagaacgaucagcgagaaguuacgcucaggauaugaaaucuuuaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44767 - RNA, 1410 nt, Artificial Sequence; identical to SEQ ID NO: 44641
  neuraminidase__InfluenzaA__AAY44909

SEQ ID NO: 44768 - RNA, 1410 nt, Artificial Sequence; identical to SEQ ID NO: 44669
  neuraminidase__InfluenzaA__AAY45649

SEQ ID NO: 44769 - RNA, 1410 nt, Artificial Sequence
  neuraminidase__InfluenzaA__AAY46374
augaauccaaaucaaaagauaauaacgauuggcucuguuucucucacuauugccacaauaugcuuccuuaugcaaauagccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggauaauucaauucggcuuuccgcugguggggacauuugggugacaagagaaccuuaugugucaugcgauccuuacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaaguguguauagcaugguccagcucaaguugucacgauggaaaagcauggcugcauguuuguguaacugggcaugaugaaaaugcaacugcuagcuucauuuacgaugggagacuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauacuagcaaauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacaccuagaaaaaacgacagcuccagcaguagccauugccuggauccuaacaaugaagaagggggucauggagugaaaggcugggccuuugaugauggaaaugacguguggaugggaagaacgaucagcgagaagucacgcucugguuaugaaaccuucaaggucauugaaggcugguccaaaccuaacuccaaauugcagauaaauaggcaagucauaguugaaagagguaauauguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44770 - RNA, 1410 nt, Artificial Sequence
  neuraminidase__InfluenzaA__AAY46384
augaauccaaaucaaaagauaauaacaauuggcucuguuucccucaccauugccacaauaugcuuccuuaugcaaauugccaucuugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacgcaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucuggcauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 44771 - RNA, 1410 nt, Artificial Sequence
  neuraminidase__InfluenzaA__AAY46394
augaauccaaaucaaaagauaauaacgauuggcucuguuucucucaccauugccacaauaugcuuccuuaugcaaauugccauccugauaacuacuguaacauugcauuucaagcaauaugaaugcaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauagacccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacauugaucucaugccuauauaa

SEQ ID NO: 44772 - RNA, 1410 nt, Artificial Sequence
  neuraminidase__InfluenzaA__AAY46419
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauacuagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacaaugaaaaugcaacugcuagcuucauuuacggugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggaguaaaaggcugggcauuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44773 - RNA, 1410 nt, Artificial Sequence
  neuraminidase__InfluenzaA__AAY47016
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaaaugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacagugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaguuacagauaaacaggcaagucauaguugaaagaggcaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44774 - RNA, 1410 nt, Artificial Sequence
  neuraminidase__InfluenzaA__AAY47055
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggaaucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucuuuccuauauaa

SEQ ID NO: 44775 - RNA, 1410 nt, Artificial Sequence
  neuraminidase__InfluenzaA__AAY47078
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacaucacaggauuugcaccuuuuucuaaggacaauucgauucggcuuuccgcugguggggacaucugggugacaagagaaccuuaugugucaugcgaucaugacaaguguuaucaauuugcccuuggacagggaacaacacuaaacaacgggcauucgaaugacacaguacaugauaggaccccuuaccggacccuauugaugaaugaguuggguguuccauuucauuugggaaccaagcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucaggacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcccagcaugucgaggagugcuccuguuauccucgauauccuggugucagaugugucugcagggacaacuggaaaggcuccaauaggcccaucguagauauaaauguaaaggauuauagcauuguuuccaguuaugugugcucaggacuuguuggagacacacccagaaaaaaugacagcuucagcaguagccauugccuagauccuaacaaugaggaagguggucacggagugaagggcugggccuuugaugauggaaaugacguuuggaugggaagaacgaucagcgagaaguuacgcucagguuaugaaaccuucaaagucaucgaaggcugguccaaaccuaacuccaaauugcagauaaauaggcaagucauaguugaaagaggaaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44776 - RNA, 1410 nt, Artificial Sequence
  neuraminidase__InfluenzaA__AAY47088
augaauccaaaucaaaagauaauaacgauuggcucuguuucccucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauuaucaggaagugcucagcaugucgaggagugcuccuguuauccucgauauccuggugucagaugugucugcagagacaacuggaaaggcuccaauaggcccaucguagauauaaacauaaaggaucauagcauuguuuccaguuaugugugcucaggacuuguuggagacacacccagaaaaaacgacagcuccaguaguagccauugcuuggacccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagagguaacagguccgguuauucugguauuuucucuguugaaggcaaaagcugcaucaaucggugcuuuuauguggaguugauaaggggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 44777 - RNA, 1410 nt, Artificial Sequence; identical to SEQ ID NO: 44641
  neuraminidase__InfluenzaA__AAY58319

SEQ ID NO: 44778 - RNA, 1392 nt, Artificial Sequence
  neuraminidase__InfluenzaA__AAY59038
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44779 - RNA, 1410 nt, Artificial Sequence
  neuraminidase__InfluenzaA__AAY64195
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaccugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuccgcucagguuaugaaaccuucaaagucauugaaggcugguccaaaccuaacucuaaauugcagauaaauaggcaagucauaguugacagagauaauagguccgguuauucugguauuuucucuguugaaggcaaaagcugcaucaaucggugcuuuuauguggaguugauaaggggaaggaaacaggaagcugaaguaugguggaccucaaacaguauuguuguguuuuguggcaccucagguacauauggaacaggcucauggccugauggggcggacaucaaucucaugccuauauaa

SEQ ID NO: 44780 - RNA, 1410 nt, Artificial Sequence; identical to SEQ ID NO: 44644
  neuraminidase__InfluenzaA__AAY64205

SEQ ID NO: 44781 - RNA, 1410 nt, Artificial Sequence; identical to SEQ ID NO: 44673
  neuraminidase__InfluenzaA__AAY64215

SEQ ID NO: 44782 - RNA, 1410 nt, Artificial Sequence
  neuraminidase__InfluenzaA__AAY64225
augaauccaaaucaaaagauaauaacaauuggcucuguuucucucaccauugccacaauaugcuuccucaugcaaauuaccauccugguaacuacuguaacauugcauuucaagcaguaugaaugcaacccccccccaaacaaccaaguaaugcugugugaaccaacaauaauagaaagaaacauaacagagauaguguaucugaccaacaccaccauagagaaggaaauaugcccaaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacggacauucgaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugacacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaaaugaagucugguggaccucaaacaguauuguuguguuuuguggcaccucagguacauauggaacaggcucauggccugauggggcggauaucaaucucaugccuauauaa

SEQ ID NO: 44783 - RNA, 1410 nt, Artificial Sequence
  neuraminidase__InfluenzaA__AAY64245
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauacuagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacggugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggaguaaaaggcugggcauuugaugauggaaaugacguguggaugggaagaacgaucagcgagaaauuccgcucagguuaugaaaccuucaaagucauugaaggcugguccaaaccuaacuccaaauugcagauaaauaggcaggucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44784 - RNA, 1410 nt, Artificial Sequence
  neuraminidase__InfluenzaA__AAY64255
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacaggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaagggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44785 - RNA, 1410 nt, Artificial Sequence
  neuraminidase__InfluenzaA__AAY64265
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauacuagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacggugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggaguaaaaggcugggcauuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44786 - RNA, 1410 nt, Artificial Sequence
  neuraminidase__InfluenzaA__AAY64285
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauacuagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacggugggaggcuuguagauaguauugguucaugguccaaaaaaauccucaggacccaggagucggaaugcguuuguaucaauggaacuuguacaguaguaaugacugaugggagugcuucaggaagagcugauacuaaaauauuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggaguaaaaggcugggcauuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44787 - RNA, 1410 nt, Artificial Sequence
  neuraminidase__InfluenzaA__AAY64295
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuaucagaauacagaaauuggucaaagccgcaauguaacaucacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaguuggguguuccauuucauuugggaaccaagcaagugugcauagcaugguccagcucaaguugucacgauggaaaagcauggcugcauguuuguguaacuggggaugaugaaaaugcaacugcuagcuucauuuauaaugggaggcuuguagauaguauugguucaugguccaaaaaaauacucaggacccaggagucggaaugcguuuguaucaauggaacuuguacaguaguaaugacugaugggagugcuucaggaaaagcugauacuaaaauacuauucauugaggaggggaaaaucguucauauuagcacauugucaggaagugcucagcaugucgaggagugcuccuguuauccucgauauccuggugucagaugugucuguagggacaauuggaaaggcuccaauaggcccaucguagauauaaauguaaaggaccauagcauuguuuccaguuaugugugcucaggacuuguuggagacacacccagaaaaaaugacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauugcagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucggguacauauggaacaggcucauggccugauggggcggauaucaaucucaugccuauauaa

SEQ ID NO: 44788 - RNA, 1410 nt, Artificial Sequence
  neuraminidase__InfluenzaA__AAY64305
augaauccaaaucaaaagauaauaacgauuggcucuguuucucucacuauugccacaauaugcuuccuuaugcaaauagccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggauaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaaguguguauagcaugguccagcucaaguugucacgauggaaaagcauggcugcauguuuguguaacugggcaugaugaaaaugcaacugcuagcuucauuuacgaugggagacuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauacuagcaaauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccuggauccuaacaaugaagaagggggucauggagugaaaggcugggccuuugaugauggaaaugacguguggaugggaagaacgaucagcgagaagucacgcucagguuaugaaaccuucaaggucauugaaggcugguccaaaccuaacuccaaauugcagauaaauaggcaagucauaguugaaagagguaauauguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44789 - RNA, 1410 nt, Artificial Sequence; identical to SEQ ID NO: 44754
  neuraminidase__InfluenzaA__AAY64335

SEQ ID NO: 44790 - RNA, 1410 nt, Artificial Sequence
  neuraminidase__InfluenzaA__AAY64365
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagagggaaauaugccccaaacuagcagaauacagaaauuggucaaagccgcaauguaacauuacaggauuugcaccuuuuucuaaggacaauucgauucgacuuuccgcugguggugacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaguguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 44791 - RNA, 1410 nt, Artificial Sequence
  neuraminidase__InfluenzaA__AAY64385
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauacuagaaagaaacauaacagagauaguguaucuaaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacggugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggaguaaaaggcugggcauuugaugauggaaaugacguguggaugggaagaacgaucagcgagaaaucccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44792 - RNA, 1410 nt, Artificial Sequence
  neuraminidase__InfluenzaA__AAY64395
augaauccaaaucaaaagauaauaacgauuggcucuguuucucucaucauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauuaaggaggggaaaaucguucauacuagcacauugucaggaagugcucagcaugucgaggagugcuccuguuauccucgauauccuggugucagaugugucugcagagacaauuggaaaggcuccaauaggcccaucguagauauaaacauaaaggauuauagcauuguuuccaguuaugugugcucaggacuuguuggagacacacccagaaaaaacgacagcuccagcagcagccauugcuuggauccuaacaaugaagaagguggucauggagugaaaggcugggccuuugaugauggaaaugacguguggaugggaagaacgaucagcgaaaaguuacgcucaggauaugaaaccuucaaagucauugaaggcugguccaacucuaauuccaaauugcagauaaauaggcaagucauaguugacagggguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44793 - RNA, 1410 nt, Artificial Sequence
  neuraminidase__InfluenzaA__AAY64405
augaauccaaaccaaaagauaauaacgauuggcucuguuucucucacuauugccacaauaugcuuccuuaugcaaauagccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggauaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaaguguguauagcaugguccagcucaaguugucacgauggaaaagcauggcugcauguuuguguaacugggcaugaugaaaaugcaacugcuagcuucauuuacgaugggagacuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauacuagcaaauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccuggauccuaacaaugaagaagggggucauggagugaaaggcugggccuuugaugauggaaaugacguguggaugggaagaacgaucagcgagaagucacgcucagguuaugaaaccuucaaggucauugaaggcugguccaaaccuaacuccaaauugcagauaaauaggcaagucauaguugaaagagguaauauguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44794 - RNA, 1410 nt, Artificial Sequence; identical to SEQ ID NO: 44785
  neuraminidase__InfluenzaA__AAY98040

SEQ ID NO: 44795 - RNA, 1410 nt, Artificial Sequence
  neuraminidase__InfluenzaA__AAY98050
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauacuagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguugggaguuccauuucauuugggaaccaagcaagugugcauagcaugguccagcucaaguugucacgauggaaaagcauggcugcauguuuguguaacugggcacgaugaaaaugcaacugcuagcuucauuuacggugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggaguaaaaggcugggcauuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44796 - RNA, 1410 nt, Artificial Sequence; identical to SEQ ID NO: 44761
  neuraminidase__InfluenzaA__AAY98060

SEQ ID NO: 44797 - RNA, 1410 nt, Artificial Sequence
  neuraminidase__InfluenzaA__AAY98070
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggaucauagcauuguuuccaguuaugugugcucaggacuuguuggagacacacccagaaaaaacgacagcuucagcaguagccauugccuagacccuaacaaugaggaagguggucauggagugaaaggcugggccuuugaugauggaaaugacguguggaugggaagaacgaucagcgagaaguuacgcucagguuaugaaaucuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44798 - RNA, 1410 nt, Artificial Sequence
  neuraminidase__InfluenzaA__AAY98080
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagagaaggaaauaugccccaaauuagcagaauacagaaauuggucaaagccgcaauguaacauuacaggauuugcaccuuuuuccaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuacaggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacgaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguuaauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaaguuugguggaccucaaacaguauuguuguguuuuguggcaccucagguacauauggaacaggcucauggccugauggggcggauaucaaucucaugccuauauaa

SEQ ID NO: 44799 - RNA, 1410 nt, Artificial Sequence
  neuraminidase__InfluenzaA__AAY98090
augaauccaaaucaaaagauaauaacgauuggcucuguuucucucacuauugccacaauaugcuuccuuaugcaaauugccauccuggugacuacuguaacauugcauuucaagcaauaugaaugcaacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacgauggaaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuccgcucagguuaugaaaccuucaaagucauugaaggcugguccaaaccuaacucuaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucuuaugccuauauaa

SEQ ID NO: 44800 - RNA, 1410 nt, Artificial Sequence; identical to SEQ ID NO: 44785
  neuraminidase__InfluenzaA__AAY98100

SEQ ID NO: 44801 - RNA, 1410 nt, Artificial Sequence; identical to SEQ ID NO: 44783
  neuraminidase__InfluenzaA__AAY98110

SEQ ID NO: 44802 - RNA, 1410 nt, Artificial Sequence; identical to SEQ ID NO: 44785
  neuraminidase__InfluenzaA__AAY98120

SEQ ID NO: 44803 - RNA, 1410 nt, Artificial Sequence; identical to SEQ ID NO: 44795
  neuraminidase__InfluenzaA__AAY98130

SEQ ID NO: 44804 - RNA, 1410 nt, Artificial Sequence; identical to SEQ ID NO: 44785
  neuraminidase__InfluenzaA__AAY98150

SEQ ID NO: 44805 - RNA, 1410 nt, Artificial Sequence
  neuraminidase__InfluenzaA__AAY98160
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauacuagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacggugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaaaugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagcaauugccugaauccuaacaaugaggaagggggucauggaguaaaaggcugggcauuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44806 - RNA, 1410 nt, Artificial Sequence; identical to SEQ ID NO: 44785
  neuraminidase__InfluenzaA__AAY98170

SEQ ID NO: 44807 - RNA, 1410 nt, Artificial Sequence; identical to SEQ ID NO: 44785
  neuraminidase__InfluenzaA__AAY98180

SEQ ID NO: 44808 - RNA, 1410 nt, Artificial Sequence; identical to SEQ ID NO: 44785
  neuraminidase__InfluenzaA__AAY98200

SEQ ID NO: 44809 - RNA, 1410 nt, Artificial Sequence; identical to SEQ ID NO: 44785
  neuraminidase__InfluenzaA__AAY98210

SEQ ID NO: 44810 - RNA, 1410 nt, Artificial Sequence; identical to SEQ ID NO: 44788
  neuraminidase__InfluenzaA__AAY98220

SEQ ID NO: 44811 - RNA, 1410 nt, Artificial Sequence; identical to SEQ ID NO: 44783
  neuraminidase__InfluenzaA__AAY98230

SEQ ID NO: 44812 - RNA, 1410 nt, Artificial Sequence
  neuraminidase__InfluenzaA__AAY98250
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauacuagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacggugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggaguaaaaggcugggcauuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaagacaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44813 - RNA, 1410 nt, Artificial Sequence; identical to SEQ ID NO: 44785
  neuraminidase__InfluenzaA__AAY98322

SEQ ID NO: 44814 - RNA, 1410 nt, Artificial Sequence; identical to SEQ ID NO: 44788
  neuraminidase__InfluenzaA__AAY98332

SEQ ID NO: 44815 - RNA, 1410 nt, Artificial Sequence; identical to SEQ ID NO: 44795
  neuraminidase__InfluenzaA__AAY98342

SEQ ID NO: 44816 - RNA, 1410 nt, Artificial Sequence; identical to SEQ ID NO: 44785
  neuraminidase__InfluenzaA__AAY98359

SEQ ID NO: 44817 - RNA, 1410 nt, Artificial Sequence
  neuraminidase__InfluenzaA__AAY98369
augaauccaaaucaaaagauaauaacgauuggcucuguuucucucacuauugccacaauaugcuuccuuaugcaaauagccauccugguaacuacuguaacguugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggauaauucaauucggcuuuccgcugguggggacauuugggugacaagagaaccuuaugugucaugcgauccugacaaguguuaucaauuugcccuuggacagggaacaacacuaaacaacaggcauucaaaugacacuguacaugauaggaccccuuaucgaacccuauugaugaaugaguuggguguuccauuucauuugggaaccaagcaaguguguauagcaugguccagcucaaguugucacgauggaaaagcauggcugcauguuuguguaacugggcaugaugaaaaugcaacugcuagcuucauuuacgaugggagacuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucacacuagcaaauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccuggauccuaacaaugaagaagggggucauggagugaaaggcugggccuuugaugauggaaaugacguguggaugggaagaacgaucagcgagaagucacgcucagguuaugaaaccuucaaggucauugaaggcugguccaaaccuaacuccaaauugcagauaaauaggcaagucauaguugaaagagguaauauguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44818 - RNA, 1410 nt, Artificial Sequence
  neuraminidase__InfluenzaA__AAY98379
augaauccaaaucaaaagauaauaacgauuggcucugucucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaacgacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugccagcuucauuuacggugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgguauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggaguaaaaggcugggccuuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagaaauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44819 - RNA, 1410 nt, Artificial Sequence
  neuraminidase__InfluenzaA__AAY98389
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacggugggaggcuuguagauagcauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggaguaaaaggcugggccuuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44820 - RNA, 1410 nt, Artificial Sequence; identical to SEQ ID NO: 44785
  neuraminidase__InfluenzaA__AAY98399

SEQ ID NO: 44821 - RNA, 1410 nt, Artificial Sequence; identical to SEQ ID NO: 44785
  neuraminidase__InfluenzaA__AAY98409

SEQ ID NO: 44822 - RNA, 1410 nt, Artificial Sequence; identical to SEQ ID NO: 44785
  neuraminidase__InfluenzaA__AAY98773

SEQ ID NO: 44823 - RNA, 1410 nt, Artificial Sequence
  neuraminidase__InfluenzaA__AAZ32955
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgccgguggggacaucugggugacaagagaaccuuaugugucaugcgauccugacaaguguuaucaauuugcccuuggacagggaacaacacuaaacaacgugcauucaaaugacauaguacaugaaaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggagacuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaauuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagagguaauagguccgguuauucugguauuuucucuguugaaggcaaaagcugcaucaaucggugcuuuuauguggaguugauaagaggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 44824 - RNA, 1344 nt, Artificial Sequence
  neuraminidase__InfluenzaA__AAZ32957
augaauccaaaucaaaagauaauaacgauuggcucuguuucucucaccauuuccacaauaugcuucuucaugcaaauugccauccugauaacuacuguaacauuaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggaaugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagagguaauagguccgguuauucugguauuuucucuguugaaggcaaaagcugcaucaaucggugcuuuuauguggaguugauaaggggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 44825 - RNA, 1344 nt, Artificial Sequence; identical to SEQ ID NO: 44824
  neuraminidase__InfluenzaA__AAZ32958

SEQ ID NO: 44826 - RNA, 1344 nt, Artificial Sequence; identical to SEQ ID NO: 44824
  neuraminidase__InfluenzaA__AAZ32959

SEQ ID NO: 44827 - RNA, 1410 nt, Artificial Sequence; identical to SEQ ID NO: 44788
  neuraminidase__InfluenzaA__AAZ38465

SEQ ID NO: 44828 - RNA, 1410 nt, Artificial Sequence; identical to SEQ ID NO: 44793
  neuraminidase__InfluenzaA__AAZ38476

SEQ ID NO: 44829 - RNA, 1410 nt, Artificial Sequence
  neuraminidase__InfluenzaA__AAZ38487
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauacuagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacggugggaggcuuguagauaguauugguucaugguccaaaaaaauccucaggacccaggagucggaaugcguuuguaucaauggaacuuguacaguaguaaugacugaugggagugcuucaggaagagcugauaccaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagcaauugccugaauccuaacaaugaggaagggggucauggaguaaaaggcugggcauuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44830 - RNA, 1410 nt, Artificial Sequence
  neuraminidase__InfluenzaA__AAZ38509
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacacuauugaugaaugaguuagguguuccauuucaucuggggaccaagcaagugugcauagcaugguccagcucaaguugccacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaaugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacucuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44831 - RNA, 1410 nt, Artificial Sequence
  neuraminidase__InfluenzaA__AAZ38586
augaauccaaaucaaaagauaauaacgauuggcucuguuucucucaccauuuccacaauaugcuucuuuaugcaaauugccauuuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44832 - RNA, 1410 nt, Artificial Sequence
  neuraminidase__InfluenzaA__AAZ38597
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaagcuagcagaauacagaaauuggucaaagccgcaaugugacauuacaggauuugcaccuuuuucuaaggacaauucgauuaggcuuuccgcugguggggacaucugggugacaagagaaccuuaugugucaugugauccugacaaguguuaucaauuugcccuuggacagggaacaacacuaaacaacgugcauucaaaugacacaguacaugauaggaccccuuaucgaacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuaguuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggcuccaauaggcccauuguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaagggcugggccuuugaugauggaaaugacguauggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44833 - RNA, 1410 nt, Artificial Sequence
  neuraminidase__InfluenzaA__AAZ38608
augaauccaaaucaaaagauaauaacgauuggcucuguuucucucaccauuuccacaauaugcuuuuucaugcaaauugccaucuugauaacuacuguaacauugcauuucaagcaauaugaauucaacucccccccaaacaaccaagugaugcugugugaaccaacaauaauagaaagaaacauaacagagauuguguaucugaccaacaccaccauagagaaggaaaugugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaccaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucauucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaaaccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaccaaucucaugccuauauaa

SEQ ID NO: 44834 - RNA, 1410 nt, Artificial Sequence
  neuraminidase__InfluenzaA__AAZ38619
augaauccaaaucaaaagauaauaacgauuggcucuguuucucucaccauuuccacaauaugcuucuucaugcaaauugccauccugauaaccacuguaacauugcauuucaagcaauaugaauucaacucccccccaaacaaccaagugaugcugugugaaccaacaauaauagaaagaaacauaacagagauaguguaucugaccaacaccaccauagagaaggaaaugugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgacccugacaaguguuaccaauuugcccuuggacagggaacaacacuaaacaacgugcauucaaaugacacaguacaugauaggaccccuuaucggacccuauugaugaaugaauuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucauucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucagggcuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaaaccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44835 - RNA, 1410 nt, Artificial Sequence
  neuraminidase__InfluenzaA__AAZ38641
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuuuauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauaguauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauagucgacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44836 - RNA, 1410 nt, Artificial Sequence
  neuraminidase__InfluenzaA__AAZ38653
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacacuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44837 - RNA, 1410 nt, Artificial Sequence
  neuraminidase__InfluenzaA__AAZ43386
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacaggaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauccucaggacccaggagucggaaugcguuuguaucaaugggacuuguacaguaguaaugacugauggaagugcuucaggaagagcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaauagcuauugccggaauccuaacaaugagaaagggaaucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 44838 - RNA, 1410 nt, Artificial Sequence
  neuraminidase__InfluenzaA__AAZ43397
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagagggaaauaugccccaaacuagcagaauacagaaauuggucaaagccgcaauguaacauuacaggauuugcaccuuuuucuaaggacaauucgauucgacuuuccgcugguggugacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaguguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 44839 - RNA, 1410 nt, Artificial Sequence
  neuraminidase__InfluenzaA__AAZ43408
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaaugauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44840 - RNA, 1410 nt, Artificial Sequence
  neuraminidase__InfluenzaA__AAZ74355
augaauccaaaucaaaagauaauaacaauuggcucuguuucucucaccauugccacaauaugcuuccuuaugcaaauugccauccugguaaccacuguaacauugcauuucaagcagcacgaaugcaacucccccccaaacaaccaagcaaugccgugugaaccagcaauaauagaaagaaacacaacagagacaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaagaggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44841 - RNA, 1410 nt, Artificial Sequence
  neuraminidase__InfluenzaA__AAZ74366
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacgauggaaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucauucauauuagucaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuccgcucagguuaugaaaccuucaaagucauugaaggcugguccaaaccuaacucuaaauugcagauaaauaggcaagucauaguugacaaagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucuuaugccuauauaa

SEQ ID NO: 44842 - RNA, 1410 nt, Artificial Sequence
  neuraminidase__InfluenzaA__AAZ74377
augaauccaaaucaaaaaauaauaacgauuggcucuguuucucucaccauugccacaauaugcuuccuuacgcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugcaacauuacuggauuugcaccuuuuucuaaggacaauucgauucggcuuuccgcugguggggacaucuggguuacaagagaaccuuaugugucaugcgauccugacaaguguuaucaauuugcccuuggacagggaacaacacuaaacaacgggcauucaaaugacacaguacaugauaggaccccuuauaggacccuauugaugaaugaguuggguguuccauuucauuugggaaccaagcaagugugcauagcaugguccagcucaaguugucacgauggaaaagcauggcugcauguuuguguaacgggggaugauaaaaaugcaacugcuagcuucauuuacaaugggaggcuuguagauaguauagguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagagagaaguuacgcucaggauaugaaaccuucaaagucauugaaggcugguccaaaccuaacuccaaacugcagauaaauaggcaagucauaguugacagagauaauagguccgguuauucugguauuuucucuguugaaggcaaaagcugcaucaaucggugcuuuuauguggaguugauaaggggaaggaaccaggaaacugaagucuuguggaccucaaacaguauuguuguguuuuguggcaccucagguacauauggaacaggcucauggccugauggggcggacaucaaucucaugccuauauaa

SEQ ID NO: 44843 - RNA, 1410 nt, Artificial Sequence
  neuraminidase__InfluenzaA__AAZ74400
augaauccaaaucaaaagauaauaacgauuggcucuguuucucucacuauugccacaauaugcuuccuuaugcaaauagccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggauaauucaauucggcuuuccgcugguggggacauuugggugacaagagagccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaaguguguauagcaugguccagcucaaguugucacgauggaaaagcauggcugcauguuuguguaacugggcaugaugaaaaugcaacugcuagccucauuuacgaugggagacuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauacuagcaaauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccuggauccuaacaaugaagaagggggucauggagugaaaggcugggccuuugaugauggaaaugacguguggaugggaagaacgaucagcgagaagucacgcucugguuaugaaaccuucaaggucauugaaggcugguccaaaccuaacuccaaauugcagauaaauaggcaagucauaguugaaagagguaauauguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44844 - RNA, 1410 nt, Artificial Sequence
  neuraminidase__InfluenzaA__AAZ74411
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauacuagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugugauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacggugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggaguaaaaggcugggcauuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggagcggacaucaaucucaugccuauauaa

SEQ ID NO: 44845 - RNA, 1410 nt, Artificial Sequence
  neuraminidase__InfluenzaA__AAZ74422
augaauccaaaucaaaagauaauaacgauuggcucuguuucucucaccauuuccacaauaugcuucuucaugcaaauugccaucuugauaaccacuguaacauugcauuucaagcaauaugaauucaacucccccccaaacaaccaagugaugcugugugaaccaacaauaauagaaagaaacauaacagagauaguguaccugaccaacaccaccauagagaaggaaauaugccccaaaccagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuaguagauaguauuguuucaugguccaaagaaauccucaggacccaggagucagaaugcguuuguaucaauggaacuugugcaguaguaaugacugaugggagcgcuucaggaaaagcugauacuaaaauacuauucauugaggaggggaaaaucguucauacuagcaaauugucaggaagugcucagcaugucgaggagugcuccugcuauccucgauauccugguaucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaauccuaauuccaaauugcagauaaauaggcaagucauaguugauagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44846 - RNA, 1410 nt, Artificial Sequence
  neuraminidase__InfluenzaA__AAZ74444
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaguuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguggauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauaggucugguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44847 - RNA, 1410 nt, Artificial Sequence
  neuraminidase__InfluenzaA__AAZ74455
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuccaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguugcgcuuaggauaugaaaccuucaaagucauugaaggcugguccaacccuaauuccaaauugcagauaaauaggcaagucauaguugaaagagguaauagguccgguuauucuggcauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44848 - RNA, 1410 nt, Artificial Sequence
  neuraminidase__InfluenzaA__AAZ74477
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucaauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacaaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44849 - RNA, 1410 nt, Artificial Sequence
  neuraminidase__InfluenzaA__AAZ74488
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuccaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggauggggagaacgaucagcgagaaguugcgcuuaggauaugaaaccuucaaagucauugaaggcugguccaacccuaauuccaaauugcagauaaauaggcaagucauaguugaaagagguaauagguccgguuauucuggcauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44850 - RNA, 1410 nt, Artificial Sequence
  neuraminidase__InfluenzaA__AAZ74499
augaauccaaaucaaaagauaauaacgauuggcucuguuucucucaccauuuccacaauaugcuucuucaugcaaauugccaucuugauaaccacuguaacauugcauuucaagcaauaugaauucaacucccccccaaacaaccaagugaugcugugugaaccaacaauaauagaaagaaacauaacagagauaguguaccugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuugugcaguaguaaugacugaugggagcgcuucaggaaaagcugauacuaaaauacuauucauugaggaggggaaaaucguucauacuagcaaauugucaggaagugcucagcaugucgaggagugcuccugcuauccucgauauccugguaucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugauagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44851 - RNA, 1410 nt, Artificial Sequence
  neuraminidase__InfluenzaA__AAZ74510
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuccaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguugcgcuuaggauaugaaaccuucaaagucauugaaggcugguccaacccuaauuccaaauugcagauaaauaggcaagucauaguugaaagagguaauagguccgguuauucuggcauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44852 - RNA, 1410 nt, Artificial Sequence; identical to SEQ ID NO: 44850
  neuraminidase__InfluenzaA__AAZ74521

SEQ ID NO: 44853 - RNA, 1410 nt, Artificial Sequence
  neuraminidase__InfluenzaA__AAZ74532
augaauccaaaucaaaagauaauaacaauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuccaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaaaugcucagcaugucgaggagugcuccugcuauccucgauauccuggugucagaugugucugcagagacaacuggaaaggcuccaauaggcccauuguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguugcgcuuaggauaugaaaccuucaaagucauugaaggcugguccaacccuaauuccaaauugcagauaaauaggcaagucauaguugaaagagguaauagguccgguuauucuggcauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 44854 - RNA, 1410 nt, Artificial Sequence; identical to SEQ ID NO: 44831
  neuraminidase__InfluenzaA__AAZ74543

SEQ ID NO: 44855 - RNA, 1410 nt, Artificial Sequence
  neuraminidase__InfluenzaA__AAZ74565
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauacuagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgaugggaaagcauggcugcauguuuguguaacugggcacgaugaaaaugcaacugcuagcuucauuuacggugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggaguaaaaggcugggcauuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44856 - RNA, 1410 nt, Artificial Sequence; identical to SEQ ID NO: 44836
  neuraminidase__InfluenzaA__AAZ74598

SEQ ID NO: 44857 - RNA, 1410 nt, Artificial Sequence
  neuraminidase__InfluenzaA__AAZ74609
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaauaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauuaguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggaaugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccugaauccuaacaaugaggaagggggucauggagugaaaggcugggccuuugaugauggaaaugacguguggaugggaagaacgaucagcgaaaaguuacgcucagguuaugaaaccuucaaggucauuggaggcugguccaaaccuaacuccaaauugcagauaaauaggcaagucauaguugacagagguaauagguccgguuauucugguauuuucucuguugaaggcaaaagcugcgucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44858 - RNA, 1410 nt, Artificial Sequence
  neuraminidase__InfluenzaA__AAZ74620
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagugagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44859 - RNA, 1410 nt, Artificial Sequence; identical to SEQ ID NO: 44677
  neuraminidase__InfluenzaA__AAZ79508

SEQ ID NO: 44860 - RNA, 1410 nt, Artificial Sequence
  neuraminidase__InfluenzaA__AAZ79519
augaauccaaaucaaaagauaauaacgauuggcucuguuucucucacuauugccacaauaugcuuccuuaugcaaauugccauccugguaacuacuguaacauugcauuucaagcaauaugaaugcaacucucccccaaacaaccaaguaaugcugugugaaccaacaauacuagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgauaaaaaugcaacagcuagcuucauuuacggugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggaguaaaaggcugggcauuugaugauggaaaugacguguggaugggaagaacgaucagcgagaaauuccgcucagguuaugaaaccuucaaagucauugaaggcugguccagaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44861 - RNA, 1410 nt, Artificial Sequence; identical to SEQ ID NO: 44641
  neuraminidase__InfluenzaA__AAZ79530

SEQ ID NO: 44862 - RNA, 1410 nt, Artificial Sequence
  neuraminidase__InfluenzaA__AAZ79552
augaauccaaaucaaaaaauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugcaacauuacuggauuugcaccuuuuucuaaggacaauucgauucggcuuuccgcugguggggacaucuggguuacaagagaaccuuaugugucaugcgauccugacaaguguuaucaauuugcccuuggacagggaacaacacuaaacaacgggcauucaaaugacacaguacaugauaggaccccucauaggacccuauugaugaaugaguuggguguuccauuucauuugggaaccaagcaagugugcauagcaugguccagcucaaguugucacgauggaaaagcauggcugcauguuuguguaacgggggaugauaaaaaugcaacugcuagcuucauuuacaaugggaggcuuguagauaguauagguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagauaauagguccgguuauucugguauuuucucuguugaaggcaaaagcugcaucaaucggugcuuuuauguggaguugauaaggggaaggaaccaggaaacugaagucuuguggaccucaaacaguauuguuguguuuuguggcaccucagguacauauggaacaggcucauggccugauggggcggacaucaaucucaugccuauauaa

SEQ ID NO: 44863 - RNA, 1410 nt, Artificial Sequence; identical to SEQ ID NO: 44795
  neuraminidase__InfluenzaA__AAZ79563

SEQ ID NO: 44864 - RNA, 1410 nt, Artificial Sequence; identical to SEQ ID NO: 44785
  neuraminidase__InfluenzaA__AAZ79574

SEQ ID NO: 44865 - RNA, 1410 nt, Artificial Sequence
  neuraminidase__InfluenzaA__AAZ79585
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauacuagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacggugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggaguaaaaggcugggcauuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguagaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44866 - RNA, 1410 nt, Artificial Sequence; identical to SEQ ID NO: 44850
  neuraminidase__InfluenzaA__AAZ79618

SEQ ID NO: 44867 - RNA, 1410 nt, Artificial Sequence
  neuraminidase__InfluenzaA__AAZ79633
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaagcuagcagaauacagaaauuggucaaagccgcaaugugacauuacaggauuugcaccuuuuucuaaggacaauucgauuaggcuuuccgcugguggggacaucugggugacaagagaaccuuaugugucaugugauccugacaaguguuaucaauuugcccuuggacagggaacaacacuaaacaacgugcauucaaaugacacaguacaugauaggaccccuuaucgaacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuaguuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggcuccaauaggcccauuguagauauaaacauaaaggauuauagcauuguuuccaguuaugugugcucaggacuuguuggagacacacccagaaaaaacgacagcuccagcaguagccauugcuuagauccuaacaaugaagaagguggucauggagugaagggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44868 - RNA, 1410 nt, Artificial Sequence; identical to SEQ ID NO: 44850
  neuraminidase__InfluenzaA__AAZ79945

SEQ ID NO: 44869 - RNA, 1410 nt, Artificial Sequence; identical to SEQ ID NO: 44847
  neuraminidase__InfluenzaA__AAZ79966

SEQ ID NO: 44870 - RNA, 1410 nt, Artificial Sequence
  neuraminidase__InfluenzaA__AAZ79977
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44871 - RNA, 1410 nt, Artificial Sequence
  neuraminidase__InfluenzaA__AAZ79988
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44872 - RNA, 1410 nt, Artificial Sequence
  neuraminidase__InfluenzaA__AAZ79999
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaaaugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuccaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguugcgcuuaggauaugaaaccuucaaagucauugaaggcugguccaacccuaauuccaaauugcagauaaauaggcaagucauaguugaaagagguaauagguccgguuauucuggcauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44873 - RNA, 1410 nt, Artificial Sequence
  neuraminidase__InfluenzaA__AAZ80010
augaauccaaaucaaaagauaauaacaauuggcucugucucucucaccauugcaacaguaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauugaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuacgaugggaggcuuguggacaguauugguucauggucucaaaauauccucaggacccaggagucggaaugcguuuguaucaaugggacuuguacaguaguaaugacugauggaagugcuucaggaagagcugauacuagaauacuauucauugaagaggggaaaauuguccauauuagcccauugucaggaagugcucagcauguagaggaguguuccuguuauccucgauauccuggcgucagauguaucugcagagacaacuggaaaggcucuaauaggcccgucguagauauaaaugugaaagauuauagcauugauucccguuaugugugcucagggcuuguuggcgacacacccagaaacaacgacagaucuagcaauagcaauugcaggaauccuaacaaugauaaagggaaucauggagugaaaggcugggccuuugacgauggaaaugacguguggaugggaagaacgaucagcaaggauucacgcucagguuaugaaaccuucaaagucauuggugguugguccacaccuaauuccaaaucacagauaaauaggcaagucauaguugacagcgauaauaggucagguuauucugguauuuucucuguugagggcaaaagcugcaucaauaggugcuuuuacguggaguugauaaggggaagggaacaggagacuagaguaugguggaccucaaacaguauuguuguguuuuguggcacuucugguaccuaugggacaggcucauggccugauggggcggacaucaaucucaugccuauauaa

SEQ ID NO: 44874 - RNA, 1410 nt, Artificial Sequence
  neuraminidase__InfluenzaA__AAZ80021
augaauccaaaucaaaagauaauaacgauuggcucuguuucucucaccauuuccacaauaugcuucuucaugcaaauugccaucuugauaaccacuguaacauugcauuucaagcaauaugaauucaacucccccccaaacaaccaagugaugcugugugaaccaacaauaauagaaagaaacauaacagagauaguguaccugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuugugcaguaguaaugacugaugggagcgcuucaggaaaagcugauacuaaaauacuauucauugaggaggggaaaaucguucauacuagcaaauugucaggaagugcucagcaugucgaggagugcuccugcuauccucgauauccugguaucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugauagagguaauagguccgguuauucugguauuuucucuguugaaggcaaaagcugcaucaaucggugcuuuuauguggaguugauaaggggaagaaaagaggaaaccgaagucuuguggaccucaaacaguauuguuguguuuuguggcaccucagguacauauggaacaggcucauggccugauggggcggacaucaaucucaugccuauauaa

SEQ ID NO: 44875 - RNA, 1410 nt, Artificial Sequence
  neuraminidase__InfluenzaA__AAZ83245
augaauccaaaucagaagauaauaacgauuggcucuguuucucucaccauuuccacaauaugcuucuucaugcaaauugccauccugauaacuacuguaacauugcauuucaagcaauaugaauucaacccccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaguguuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaauuacgcucaggauaugaaaccuucaaagucauugaaggcugguccaacccuaacuccaaauugcagauaaauaggcaagucauaguugacagagauaauagguccgguuauucugguauuuucucuguugaaggcaaaagcugcaucaaucggugcuuuuauguggaguugauaaggggaagaaaccaggaaacugaagucuuguggaccucaaacaguauuguuguguuuuguggcaccucagguacauauggaacaggcucauggccugauggggcggacaucaaucucaugccuauauaa

SEQ ID NO: 44876 - RNA, 1413 nt, Artificial Sequence
  neuraminidase__InfluenzaA__AAZ83256
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuccauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcauugauagugauacugcaaacuggucuuggccagacggugcugaguugccguucaccauugacaaguag

SEQ ID NO: 44877 - RNA, 1410 nt, Artificial Sequence; identical to SEQ ID NO: 44785
  neuraminidase__InfluenzaA__AAZ83269

SEQ ID NO: 44878 - RNA, 1410 nt, Artificial Sequence; identical to SEQ ID NO: 44785
  neuraminidase__InfluenzaA__AAZ83280

SEQ ID NO: 44879 - RNA, 1410 nt, Artificial Sequence
  neuraminidase__InfluenzaA__AAZ83291
augaauccaaaucaaaagauaauaacgauuggcucuguuucucucaccauugcuacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacaaggaacaacacuaaacaacgggcauucaaaugacacaguacaugauaggaccccuuaucgaacccuauugaugaaugaguuggguguuccauuucauuugggaaccaaacaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcauguugaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44880 - RNA, 1413 nt, Artificial Sequence
  neuraminidase__InfluenzaA__AAZ83302
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaagcuucagugacauuggccggcaauucaucucuuuguucuaucaguggaugggcuauauacacaaaagacaacagcauaagaauugguuccaaaggagauguuuuugucauaagagagccuuucauaucauguucucacucggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcugcaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 44881 - RNA, 1410 nt, Artificial Sequence
  neuraminidase__InfluenzaA__AAZ83315
augaauccaaaucaaaagauaauaacgauuggcucuguuucucucacuauugccacaauaugcuuccuuaugcaaauugccauccugguaacuacuguaacacugcauuucaagcaauaugaaugcaacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcuaauacuaaaauacuauucauugaggaggggaaaaucauucauauuagccaauugucaggaagugcucagcaugucgaggagugcucaugcuauccucgauauccuggugucagaugugucugcagagacaacuggaaaggcuccaauaggcccauuguagauauaaauguaaaggauuauagcauagcuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44882 - RNA, 1410 nt, Artificial Sequence
  neuraminidase__InfluenzaA__AAZ83326
augaauccaaaucaaaagauaauaacgauuggcucuguuucucucacuauugccacaauaugcuuccuuaugcaaauugccauccugguaacuacuguaacauugcauuucaagcaauaugaaugcgacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcucuccgcugguggggacauuugggugacaagagaaccuuaugugucaugcgauccugacaaguguuaucaauuugcccuuggacagggaacaacacuaaacaacagacauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacgaugggaggcuuguagauaguauugguucaugguccaaaaaaauccucaggacccaggagucugaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuccgcucagguuaugaaacuuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44883 - RNA, 1410 nt, Artificial Sequence
  neuraminidase__InfluenzaA__AAZ83374
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcacaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaauugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44884 - RNA, 1410 nt, Artificial Sequence; identical to SEQ ID NO: 44850
  neuraminidase__InfluenzaA__AAZ83385

SEQ ID NO: 44885 - RNA, 1413 nt, Artificial Sequence
  neuraminidase__InfluenzaA__AAZ85129
augaauacaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacuaccaaaagaaaauacaacaaucuggacuagugggagcagcauuucuuuuuguggcguaaauagugauacugcaaacuggucuuggccagacggugcugaguugccguuuacuauugacaaguag

SEQ ID NO: 44886 - RNA, 1410 nt, Artificial Sequence
  neuraminidase__InfluenzaA__ABA06513
augaauccaaaucaaaaaauaauaacgauuggcucuguuucucucaccauugccacaauaugcuuccuuacgcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugcaacauuacuggauuugcaccuuuuucuaaggacaauucgauucggcuuuccgcugguggggacaucuggguuacaagagaaccuuaugugucaugcgauccugacaaguguuaucaauuugcccuuggacagggaacaacacuaaacaacgggcauucaaaugacacaguacaugauaggaccccuuauaggacccuauugaugaaugaguuggguguuccauuucauuugggaaccaagcaagugugcauagcaugguccagcucaaguugucacgauggaaaagcauggcugcauguuuguguaacgggggaugauaaaaaugcaacugcuagcuucauuuacaaugggaggcuuguagauaguauagguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagauaauagguccgguuauucugguauuuucucuguugaaggcaaaagcugcaucaaucggugcuuuuauguggaguugauaaggggaaggaaccaggaaacugaagucuuguggaccucaaacaguauuguuguguuuuguggcaccucagguacauauggaacaggcucauggccugauggggcggacaucaaucucaugccuauauaa

SEQ ID NO: 44887 - RNA, 1410 nt, Artificial Sequence
  neuraminidase__InfluenzaA__ABA06545
augaauccaaaucaaaaaauaauaacgauuggcucuguuucucucaccauugccacaauaugcuuccuuacgcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugcaacauuacuggauuugcaccuuuuucuaaggacaauucgauucggcuuuccgcugguggggacaucuggguuacaagagaaccuuaugugucaugcgauccugacaaguguuaucaauuugcccuuggacagggaacaacacuaaacaacgggcauucaaaugacacaguacaugauaggaccccuuauaggacccuauugaugaaugaguuggguguuccauuucauuugggaaccaagcaagugugcauagcaugguccagcucaaguugucacgauggaaaagcauggcuacauguuuguguaacgggggaugauaaaaaugcaacugcuagcuucauuuacaaugggaggcuuguagauaguauagguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagauaauagguccgguuauucugguauuuucucuguugaaggcaaaagcugcaucaaucggugcuuuuauguggaguugauaaggggaaggaaccaggaaacugaagucuuguggaccucaaacaguauuguuguguuuuguggcaccucagguacauauggaacaggcucauggccugauggggcggacaucaaucucaugccuauauaa

SEQ ID NO: 44888 - RNA, 1413 nt, Artificial Sequence
  neuraminidase__InfluenzaA__ABA08478
augaauacaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaauguguuugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 44889 - RNA, 1410 nt, Artificial Sequence
  neuraminidase__InfluenzaA__ABA08511
augaauccaaaucaaaaaauaauaacgauuggcucuguuucucucaccauugccacaauaugcuuccuuacgcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuggcagaauacagaaauuggucaaagccgcaaugcaacauuacuggauuugcaccuuuuucuaaggacaauucgauucggcuuuccgcugguggggacaucuggguuacaagagaaccuuaugugucaugcgauccugacaaguguuaucaauuugcccuuggacagggaacaacacuaaacaacgggcauucaaaugacacaguacaugauaggaccccuuauaggacccuauugaugaaugaguuggguguuccauuucauuugggaaccaagcaagugugcauagcaugguccagcucaaguugucacgauggaaaagcauggcugcauguuuguguaacgggggaugauaaaaaugcaacugcuagcuucauuuacaaugggaggcuuguagauaguauagguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagauaauagguccgguuauucugguauuuucucuguugaaggcaaaagcugcaucaaucggugcuuuuauguggaguugauaaggggaaggaaccaggaaacugaagucuuguggaccucaaacaguauuguuguguuuuguggcaccucagguacauauggaacaggcucauggccugauggggcggacaucaaucucaugccuauauaa

SEQ ID NO: 44890 - RNA, 1413 nt, Artificial Sequence
  neuraminidase__InfluenzaA__ABA12699
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 44891 - RNA, 1413 nt, Artificial Sequence; identical to SEQ ID NO: 44890
  neuraminidase__InfluenzaA__ABA12710

SEQ ID NO: 44892 - RNA, 1413 nt, Artificial Sequence
  neuraminidase__InfluenzaA__ABA12721
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaguaugcaaccaaagaaucaucacauaugaaaacagcaccugggugaaucacacauauguuaauauuaacaacacuaauguuauugcuggaaaggacaaaacuucagugacauuggccggcaauucaucucuuuguucaaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcuggcuaacaaucggaauuucugguccagacaauggagcuguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucggaaagggaaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccagagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggaugucguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuucuguggcguaaauagugauacugcaaacuggucuuggccagacggugcugaguugccguucaccauugacaaguag

SEQ ID NO: 44893 - RNA, 1413 nt, Artificial Sequence
  neuraminidase__InfluenzaA__ABA12732
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaagucccuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuccauuaugaggaauguuccuguuacccagacacuggcacagugaugugugugugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 44894 - RNA, 1410 nt, Artificial Sequence
  neuraminidase__InfluenzaA__ABA12743
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucaugauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauuuaa

SEQ ID NO: 44895 - RNA, 1410 nt, Artificial Sequence
  neuraminidase__InfluenzaA__ABA12754
augaauccaaaucaaaagauaauaacgauuggcucuguuucucucaccauuuccacaauauguuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaauuagguguuccauuccaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguugcgcuuaggauaugaaaccuucaaagucauugaaggcugguccaacccuaauuccaaauugcagauaaauaggcaagucauaguugaaagagguaauagguccgguuauucuggcauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44896 - RNA, 1410 nt, Artificial Sequence
  neuraminidase__InfluenzaA__ABA12765
augaauccaaaucaaaagauaauaacgauuggcucuguuucucucaccauuuccacaauaugcuucuucaugcaaauugccaucuugauaaccacuguaacauugcauuucaagcaauaugaauucaacucccccccaaacaaccaagugaugcugugugaaccaacaauaauagaaagaaauauaacagagauaguguaccugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuugugcaguaguaaugacugaugggagcgcuucaggaaaagcugauacuaaaauacuauucauugaggaggggaaaaucguucauacuagcaaauugucaggaagugcucagcaugucgaggagugcuccugcuauccucgauauccugguaucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugauagagguaauagguccgguuauucugguauuuucucuguugaaggcaaaagcugcaucaaucggugcuuuuauguggaguugauaaggggaagaaaagaggaaaccgaagucuuguggaccucaaacaguauuguuguguuuuguggcaccucagguacauauggaacaggcucauggccugauggggcggacaucaaucucaugccuauauaa

SEQ ID NO: 44897 - RNA, 1410 nt, Artificial Sequence; identical to SEQ ID NO: 44837
  neuraminidase__InfluenzaA__ABA12776

SEQ ID NO: 44898 - RNA, 1410 nt, Artificial Sequence; identical to SEQ ID NO: 44870
  neuraminidase__InfluenzaA__ABA12786

SEQ ID NO: 44899 - RNA, 1410 nt, Artificial Sequence
  neuraminidase__InfluenzaA__ABA18029
augaauccaaaucaaaagauaauaacgauuggcucuguuucucucaccauuuccacaauaugcuucuucaugcaaauugccaucuugauaaccacuguaacauugcauuucaagcaauaugaauucaacucccccccaaacaaccaagugaugcugugugaaccaacaauaauagaaagaaacauaacagagauaguguaccugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuugugcaguaguaaugacugaugggagcgcuucaggaaaagcugauacuaaaauacuauucauugaggaggggaaaaucguucauacuagcaaauugucaggaagugcucagcaugucgaggagugcuccugcuauccucgauauccugguaucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugauagagguaauagguccgguuauucugguauuuucucuguugaaggcaaaagcugcaucaaucggugcuuuuauguggaguugauaaggggaagaaaagaggaaaccgaagucuuguggaccucaaacaguauuguuguguuuuguggcaccucagguacauauggaacaggcucauggccugauggggcggacaucaaucucaugccuauauaa

SEQ ID NO: 44900 - RNA, 1413 nt, Artificial Sequence
  neuraminidase__InfluenzaA__ABA18040
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 44901 - RNA, 1410 nt, Artificial Sequence
  neuraminidase__InfluenzaA__ABA18126
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaguuggguguuccauuucauuugggaaccaagcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucaggacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacauguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44902 - RNA, 1413 nt, Artificial Sequence
  neuraminidase__InfluenzaA__ABA18148
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuuuaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggacguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 44903 - RNA, 1410 nt, Artificial Sequence
  neuraminidase__InfluenzaA__ABA18159
augaauccaaaucaaaagauaauaacgauuggcucuguuucucucaccauuuccacaauaugcuucuucaugcaaauugccaucuugauaaccacuguaacauugcauuucaagcaauaugaauucaacucccccccaaacaaccaagugaugcugugugaaccaacaauaauagaaagaaacauaacagagauaguguaccugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuugugcaguaguaaugacugaugggagcgcuucaggaaaagcugauacuaaaauacuauucauugaggaggggaaaaucguucauacuagcaaauugucaggaagugcucagcaugucgaggagugcuccugcuauccucgauauccugguaucagaugugucugcagagacaacuggaaaggcuccaauaggcccaucguagauguaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugauagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccaauauaa

SEQ ID NO: 44904 - RNA, 1410 nt, Artificial Sequence
  neuraminidase__InfluenzaA__ABA26703
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuagacuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44905 - RNA, 1410 nt, Artificial Sequence
  neuraminidase__InfluenzaA__ABA26714
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaaugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaagguugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguuuuguggaccucaaacaguauuguuguguuuuguggcaccucagguacauauggaacaggcucauggccugauggagcggacaucaaucucaugccuauauaa

SEQ ID NO: 44906 - RNA, 1410 nt, Artificial Sequence; identical to SEQ ID NO: 44870
  neuraminidase__InfluenzaA__ABA26736

SEQ ID NO: 44907 - RNA, 1410 nt, Artificial Sequence; identical to SEQ ID NO: 44870
  neuraminidase__InfluenzaA__ABA26747

SEQ ID NO: 44908 - RNA, 1410 nt, Artificial Sequence
  neuraminidase__InfluenzaA__ABA26758
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaaguugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44909 - RNA, 1410 nt, Artificial Sequence; identical to SEQ ID NO: 44870
  neuraminidase__InfluenzaA__ABA26769

SEQ ID NO: 44910 - RNA, 1410 nt, Artificial Sequence
  neuraminidase__InfluenzaA__ABA26780
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuagacuuuccgcugguggggacaucugggugacaagagaaccuuaugugucaugcgacccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaagggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44911 - RNA, 1410 nt, Artificial Sequence; identical to SEQ ID NO: 44870
  neuraminidase__InfluenzaA__ABA26791

SEQ ID NO: 44912 - RNA, 1410 nt, Artificial Sequence; identical to SEQ ID NO: 44870
  neuraminidase__InfluenzaA__ABA26802

SEQ ID NO: 44913 - RNA, 1413 nt, Artificial Sequence
  neuraminidase__InfluenzaA__ABA42250
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaauguguuugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauauggugaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 44914 - RNA, 1413 nt, Artificial Sequence; identical to SEQ ID NO: 44900
  neuraminidase__InfluenzaA__ABA42261

SEQ ID NO: 44915 - RNA, 1410 nt, Artificial Sequence
  neuraminidase__InfluenzaA__ABA42272
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuccaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucaacgagaaguugcgcuuaggauaugaaaccuucaaagucauugaaggcugguccaacccuaauuccaaauugcagauaaauaggcaagucauaguugaaagagguaauagguccgguuauucuggcauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44916 - RNA, 1410 nt, Artificial Sequence
  neuraminidase__InfluenzaA__ABA42294
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuguucauugaggaggggaaaaucguucauacuagcacauugucaggaagugcucagcaugucgaggaaugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaagguugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44917 - RNA, 1410 nt, Artificial Sequence
  neuraminidase__InfluenzaA__ABA42305
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44918 - RNA, 1410 nt, Artificial Sequence; identical to SEQ ID NO: 44762
  neuraminidase__InfluenzaA__ABA42316

SEQ ID NO: 44919 - RNA, 1413 nt, Artificial Sequence
  neuraminidase__InfluenzaA__ABA42327
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggcugccucguauaaaaucuucaagauugaaaaagggaaaguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggggcagacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 44920 - RNA, 1410 nt, Artificial Sequence
  neuraminidase__InfluenzaA__ABA42338
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagaaauaguguaucugaccaacaccaccauagagaaggaaauaugccccaaauuagcagaguacagaaauuggucaaagccgcaauguaacauuacaggauuugcaccuuuuuccaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggaaucggaaugcguuuguaucaauggaacuuguacaguaguaaugacugaugggagcgcuucaggaaaagcugauacuaaaauacuauucauugaggaggggaaaaucguuaauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauagacaagucauaguugaaagagguaacagguccgguuauucugguauuuucuccguugaaggcaaaagcugcaucaaucggugcuuuuauguggaguugauaaggggaaggaaagaggaaacugaaguuugguggaccucaaacaguauuguuguguuuuguggcaccucagguacauauggaacaggcucauggccugauggggcggauaucaaucucaugccuauauaa

SEQ ID NO: 44921 - RNA, 1410 nt, Artificial Sequence
  neuraminidase__InfluenzaA__ABA42349
augaauccaaaucaaaagauaauaacaauuggcucuguuucucucaccauugccacaauaugcuuccuuaugcaaauugccauccugguaacuacuguaacauugcauuucaagcaguaugaaugugacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaagcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44922 - RNA, 1410 nt, Artificial Sequence; identical to SEQ ID NO: 44686
  neuraminidase__InfluenzaA__ABA42360

SEQ ID NO: 44923 - RNA, 1410 nt, Artificial Sequence
  neuraminidase__InfluenzaA__ABA42371
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagagaaggaaauaugccccaaauuagcagaauacagaaauuggucaaagccgcaauguaacauuacaggauuugcaccuuuuuccaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguuaauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcauaaaucggugcuuuuauguggaguugauaaggggaaggaaagaggaaacugaaguuugguggaccucaaacaguauuguuguguuuuguggcaccucagguacauauggaacaggcucauggccugauggggcggauaucaaucucaugccuauauaa

SEQ ID NO: 44924 - RNA, 1410 nt, Artificial Sequence; identical to SEQ ID NO: 44669
  neuraminidase__InfluenzaA__ABA42382

SEQ ID NO: 44925 - RNA, 1410 nt, Artificial Sequence
  neuraminidase__InfluenzaA__ABA42393
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagagaaggaaauaugccccaaauuagcagaauacagaaauuggucaaagccgcaauguaacauuacaggauuugcaccuuuuuccaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggaaucggaaugcguuuguaucaauggaacuuguacaguaguaaugacugaugggagcgcuucaggaaaagcugauacuaaaauacuauucauugaggaggggaaaaucguuaauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaaguuugguggaccucaaacaguauuguuguguuuuguggcaccucagguacauauggaacaggcucauggccugauggggcggauaucaaucucaugccuauauaa

SEQ ID NO: 44926 - RNA, 1410 nt, Artificial Sequence
  neuraminidase__InfluenzaA__ABA42404
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagagaaggaaauaugccccaaauuagcagaauacagaaauuggucaaagccgcaauguaacauuacaggauuugcaccuuuuuccaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggaaucggaaugcguuuguaucaauggaacuuguacaguaguaaugacugaugggagcgcuucaggaaaagcugauacuaaaauacuauucauugaggaggggaaaaucguuaauauuagcacauugccaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaaguuugguggaccucaaacaguauuguuguguuuuguggcaccucagguacauauggaacaggcucauggccugauggggcggauaucaaucucaugccuauauaa

SEQ ID NO: 44927 - RNA, 1410 nt, Artificial Sequence; identical to SEQ ID NO: 44762
  neuraminidase__InfluenzaA__ABA42415

SEQ ID NO: 44928 - RNA, 1410 nt, Artificial Sequence
  neuraminidase__InfluenzaA__ABA42446
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggacuccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44929 - RNA, 1410 nt, Artificial Sequence
  neuraminidase__InfluenzaA__ABA42457
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauuaucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaagcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44930 - RNA, 1410 nt, Artificial Sequence; identical to SEQ ID NO: 44761
  neuraminidase__InfluenzaA__ABA42468

SEQ ID NO: 44931 - RNA, 1410 nt, Artificial Sequence
  neuraminidase__InfluenzaA__ABA42479
augaauccaaaucaaaagauaauaacaauuggcucuguuucucucaccauugccacaauaugcuuccuuaugcaaauugccauccugguaacuacuguaacauugcauuucaagcaguaugaaugugacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggacgguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44932 - RNA, 1410 nt, Artificial Sequence
  neuraminidase__InfluenzaA__ABA42490
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaauaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcaaauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucaaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44933 - RNA, 1410 nt, Artificial Sequence; identical to SEQ ID NO: 44761
  neuraminidase__InfluenzaA__ABA42501

SEQ ID NO: 44934 - RNA, 1410 nt, Artificial Sequence
  neuraminidase__InfluenzaA__ABA42512
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguauauccgaccaacaccaccauagagaaagaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44935 - RNA, 1410 nt, Artificial Sequence
  neuraminidase__InfluenzaA__ABA42523
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaauugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44936 - RNA, 1410 nt, Artificial Sequence; identical to SEQ ID NO: 44673
  neuraminidase__InfluenzaA__ABA42534

SEQ ID NO: 44937 - RNA, 1410 nt, Artificial Sequence
  neuraminidase__InfluenzaA__ABA42545
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguauggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44938 - RNA, 1410 nt, Artificial Sequence
  neuraminidase__InfluenzaA__ABA42556
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaagcugaagucuuguggaccucaaacaguauuguuguguuuuguggcaccucagguacauauggaacaggcucauggccugauggggcggacaucaaucucaugccuauauaa

SEQ ID NO: 44939 - RNA, 1410 nt, Artificial Sequence; identical to SEQ ID NO: 44673
  neuraminidase__InfluenzaA__ABA42567

SEQ ID NO: 44940 - RNA, 1410 nt, Artificial Sequence
  neuraminidase__InfluenzaA__ABA42931
augaauccaaaucaaaagauaauaacgauuggcucuguuucucucaccauugccacaauaugcucccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucgugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaauuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44941 - RNA, 1410 nt, Artificial Sequence; identical to SEQ ID NO: 44673
  neuraminidase__InfluenzaA__ABA42942

SEQ ID NO: 44942 - RNA, 1410 nt, Artificial Sequence; identical to SEQ ID NO: 44673
  neuraminidase__InfluenzaA__ABA42981

SEQ ID NO: 44943 - RNA, 1410 nt, Artificial Sequence
  neuraminidase__InfluenzaA__ABA42992
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagagaaggaaauaugccccaaauuagcagaauacagaaauuggucaaagccgcaauguaacauuacaggauuugcaccuuuuuccaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguuaauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaaguuugguggaccucaaacaguauuguuguguuuuguggcaccucagguacauauggaacaggcucauggccugauggggcggauaucaaucucaugccuauauaa

SEQ ID NO: 44944 - RNA, 1413 nt, Artificial Sequence
  neuraminidase__InfluenzaA__ABA43192
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcugggaaggacaaaacuucagugauauuggccggcaauucaucucuuuguucuaucaguggaugggcuauauacacaaaagacaacagcauaagaauugguuccaaaggagauguuuuugucauaagggagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguugugucaauaacugauuggucaggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 44945 - RNA, 1410 nt, Artificial Sequence
  neuraminidase__InfluenzaA__ABA43203
augaauccaaaucaaaagauaauaacgauuggcucuguuucucucaccauuuccacaauaugcuucuucaugcaaauugccaucuugauaaccacuguaacauugcauuucaagcaauaugaauucaacucccccccaaacaaccaagugaugcugugugaaccaacaauaauagaaagaaacauaacagagauaguguaccugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaauguguuuguaucaauggaacuugugcaguaguaaugacugaugggagcgcuucaggaaaagcugauacuaaaauacuauucauugaggaggggaaaaucguucauacuagcaaauugucaggaagugcucagcaugucgaggagugcuccugcuauccucgauauccugguaucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugauagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44946 - RNA, 1410 nt, Artificial Sequence
  neuraminidase__InfluenzaA__ABA43339
augaauccaaaucaaaagauaauaacaauuggcucuguuucucucuccauugccacaauaugcuuccuuaugcaaauugccauccugguaacuacuguaacacugcauuucaagcaauaugagugcagcucccccccaaacaaccaaguaaugccgugcgaaccaacaauaauagaaagaaacauaacagagauaguguauuugacuaacaccaccauagagaaagagauaugccccaaacuaguagaauacagaaauuggucaaagccgcaauguaaaauuacgggauuugcaccuuuuucuaaggacaauucaauucggcuuuccgcugguggagacauuugggugacaagagaaccuuaugugucaugcgauccuggcaaguguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauggcaugguccagcucaagcugucacgauggaaaagcauggcugcauguuugugucacugggcaugaugaaaaugcaacugcuagcuucauuuacgaugggaggcuuguagacaguauugguucaugguccaaaaauauccucaggacccaggagucggaaugcguuuguaucaaugggacuugcacaguaguaaugacugauggaagugcuucagaaagagcugauacuaaaauacuauucauugaagaggggaaaaucguucauauuagcccauugucaggaagugcucagcauguagaggagugcuccuguuauccccgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagauccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaaggaagcaggaaacuagagucugguggaccucaaacaguauuguuguguuuuguggcaccucagguacauauggaacaggcucauggccugauggggcggacaucaaucucaugccuauauaa

SEQ ID NO: 44947 - RNA, 1410 nt, Artificial Sequence
  neuraminidase__InfluenzaA__ABA54916
augaauccaaaucaaaagauaauaaccaccggaucaaucuguaugguaauuggaaugguuagcuugauguugcaaauugggaacauaaucucaauauggguuagucauucaauucagacagggacucaacaccgagcugaaccaugcaaucgaagcauuauuaauuaugaaaacaacaccuggguaaaucagacauaugucaaaaucagcaacaccaauuuucuuacugagaaagcuguggcuucaguaagauuagugggcaauucaucucuuugccccauuaguggaugggcuguauacaguaaggacaacaguauaagaaucgguuccaagggggauguguuuguuauaagagagccguucaucucaugcucccacuuggaaugccgaaccuucuuuuugacucagggagccuugcugaaugauaagcacuccaaugggaccgucaaagacagaagcccuuacagaacauugaugagcuguccugugggugaggcccccuccccauauaacucgagguuugagucuguugcuuggucggcaagugcuugucaugauggcacuaguugguugacaauuggaauuucuggcccagacaauggggcuguggcuguauugaaauacaauggcauaauaacagacacuaucaagaguuggaggaacaacauacugagagcucaagagucugaaugugcauguguaaauggcucuugcuuuacuguaaugacugacggaccaaguaaugggcaggcuucauauaagaucuucaaaauagaaaaagggaaaguaguuaaaucagucgaauugaaugccccuaauuaucacuaugaggagugcuccuguuauccugaugcuggcgaaaucacaugugugugcagggauaauuggcauggcucaaaucggccauggguaucuuucaaucaaaauuuggaguaccaaauaggauauauaugcaguggaguuuucggagacaauccacgccccaaugauggaacaggcaguugugguccgguguccccuaacggggcauauggaguaaaaggguuuucauuuaaauacggcaaugguguuuggaucgggagaaccaaaagcacuaauuccaggagcggcuuugaaaugauuugggauccaaauggguggacuggaacggacaguaauuuuucggugaagcaagauaucguagcuauaacugauuggucaggauauagcgggaguuuuguccagcauccagaacugacaggauuagauugcauaagaccuuguuucuggguugagcuaaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 44948 - RNA, 1413 nt, Artificial Sequence
  neuraminidase__InfluenzaA__ABA87048
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauagggccgccucguacaaaaucuucaagaucgaaaagggaaagguuacuaaaucaguagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcaaauggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuaaagaaaauacaacaaucuggacuagugggagcagcauuucuuuuuguggcguaaauagugauacugcaaacuggucuuggccagacggugcugaguugccguucaccauugacaaguag

SEQ ID NO: 44949 - RNA, 1413 nt, Artificial Sequence
  neuraminidase__InfluenzaA__ABA87060
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaaugggaccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaguccagugacuguugauggagcugacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 44950 - RNA, 1413 nt, Artificial Sequence
  neuraminidase__InfluenzaA__ABA87083
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaaaaaucaucacauauaaaaacagcaccugggugaaucacacauauguuaauauuaacaacacuaauguuguugcuggaaaggacaaaacuucagugacauuggccggcaauucaucucuuuguucuaucaguggaugggcuauauacacaaaagauaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccgucuccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguguuuucucagugaaacaggauguuguggcaauaacugauuggucaggguacagcggaaguuucguucaacauccugaguuaacaggauuggacuguauaagaccuuguuucuggguugaguuagucagaggacugccuagagaaaauacaacaaucuggacuagugggagcagcauuucuuuuuguggcguuaauagugauacugcaaacuggucuuggccagacggugcugaguugccguucaccauugacaaguag

SEQ ID NO: 44951 - RNA, 1413 nt, Artificial Sequence
  neuraminidase__InfluenzaA__ABA87234
augaauucaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacaguaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuauuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 44952 - RNA, 1410 nt, Artificial Sequence
  neuraminidase__InfluenzaA__ABB02784
augaauccaaaucaaaaaauaauaacgauuggcucuguuucucucaccauugccacaauaugcuuccuuacgcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaaugcaacauuacuggauuugcaccuuuuucuaaggacaauucgauucggcuuuccgcugguggggacaucuggguuacaagagaaccuuaugugucaugcgauccugacaaguguuaucaauuugcccuuggacagggaacaacacuaaacaacgggcauucaaaugacacaguacaugauaggaccccuuauaggacccuauugaugaaugaguuggguguuccauuucauuugggaaccaagcaagugugcauagcaugguccagcucaaguugucacgauggaaaagcauggcugcauguuuguguaacgggggaugauaaaaaugcaacugcuagcuucauuuacaaugggaggcuuguagauaguauagguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagauaauagguccgguuauucugguauuuucucuguugaaggcaaaagcugcaucaaucggugcuuuuauguggaguugauaaggggaaggaaccaggaaacugaagucuuguggaccucaaacaguauuguuguguuuuguggcaccucagguacauauggaacaggcucauggccugauggggcggacaucaaucucaugccuauauaa

SEQ ID NO: 44953 - RNA, 1413 nt, Artificial Sequence; identical to SEQ ID NO: 44893
  neuraminidase__InfluenzaA__ABB02795

SEQ ID NO: 44954 - RNA, 1413 nt, Artificial Sequence
  neuraminidase__InfluenzaA__ABB02806
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggacguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 44955 - RNA, 1413 nt, Artificial Sequence
  neuraminidase__InfluenzaA__ABB02817
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaguagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagaaggcagcuguaauccagugacuguugauggagcaaauggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuaaagaaaauacaacaaucuggacuagugggagcagcauuucuuuuuguggcguaaauagugauacugcaaacuggucuuggccagacggugcugaguugccguucaccauugacaaguag

SEQ ID NO: 44956 - RNA, 1413 nt, Artificial Sequence
  neuraminidase__InfluenzaA__ABB02828
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaguagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcaaauggaguaaagggguuuucauacaaauaugguaaugguguuuggauaggaaggacuaaaaguaacagacuuagaaaaggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuaaagaaaauacaacaaucuggacuagugggagcagcauuucuuuuuguggcguaaauagugauacugcaaacuggucuuggccagacggugcugaguugcccuucaccauugacaaguag

SEQ ID NO: 44957 - RNA, 1410 nt, Artificial Sequence
  neuraminidase__InfluenzaA__ABB02839
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaaguggugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaaugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaagguugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44958 - RNA, 1410 nt, Artificial Sequence
  neuraminidase__InfluenzaA__ABB02850
augaauccaaaucaaaagauaauaacgauuggcucuguuucucucaccauuuccacaauaugcuucuucaugcaaauugccaucuugauaaccacuguaacauugcauuucaagcaauaugaauucaacucccccccaaacaaccaagugaugcugugugaaccaacaauaauagaaagaaacauaacagagauaguguaccugaccaacaccaccauagagaaggaaauaugccccaaaccagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuugugcaguaguaauuacugaugggagcgcuucaggaaaagcugauacuaaaauacuauucauugaggaggggaaaaucguucauacuagcaaauugucaggaagugcucagcaugucgaggagugcuccugcuauccucgauauccugguaucagaugugucugcagagacaacuggaaaggauccaauaggcccaucguagauauaaacauaaaggauuauagcauuguuuccaguuaugugugcucaggacuuguuggagacacacccagaaaaaacgacagcuccagcaguagccuuugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugauagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44959 - RNA, 1410 nt, Artificial Sequence
  neuraminidase__InfluenzaA__ABB02861
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagagaaggaaauaugccccaaauuagcagaauacagaaauuggucaaagccgcaauguaacauuacaggauuugcaccuuuuuccaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacgaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguuaauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaaguuugguggaccucaaacaguauuguuguguuuuguggcaccucagguacauauggaacaggcucauggccugauggggcggauaucgaucucaugccuauauaa

SEQ ID NO: 44960 - RNA, 1410 nt, Artificial Sequence; identical to SEQ ID NO: 44757
  neuraminidase__InfluenzaA__ABB02872

SEQ ID NO: 44961 - RNA, 1410 nt, Artificial Sequence; identical to SEQ ID NO: 44757
  neuraminidase__InfluenzaA__ABB02883

SEQ ID NO: 44962 - RNA, 1410 nt, Artificial Sequence
  neuraminidase__InfluenzaA__ABB02894
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagaugguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcacuucagguacauauggaacaggcucauggccugauggggcggacaucaaucucaugccuauauaa

SEQ ID NO: 44963 - RNA, 1410 nt, Artificial Sequence; identical to SEQ ID NO: 44673
  neuraminidase__InfluenzaA__ABB02905

SEQ ID NO: 44964 - RNA, 1413 nt, Artificial Sequence
  neuraminidase__InfluenzaA__ABB02916
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaguaugcaaccaaagaaucaucacauaugaaaacagcaccugggugaaucacacauauguuaauauuaacaacacuaauguuauugcugaaaaggacaaaacuucagugacauuggccggcaauucaucucuuuguucaaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccagagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggaugucguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuucuguggcguaaauagugauacugcaaacuggucuuggccagacggugcugaguugccguucaccauugacaaguag

SEQ ID NO: 44965 - RNA, 1413 nt, Artificial Sequence
  neuraminidase__InfluenzaA__ABB02927
augaauccaaaucaaaaaauaauaaccauuggaucaaucaguauagcaaucggaauaaucagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagcuguaauccagugacuguugauggagcagacggaguaaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguuaauagugauacugcaaacuggucuuggccagacggugcugaguugccguucaccauugacaaguag

SEQ ID NO: 44966 - RNA, 1413 nt, Artificial Sequence
  neuraminidase__InfluenzaA__ABB02939
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccuggaugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauggaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 44967 - RNA, 1410 nt, Artificial Sequence
  neuraminidase__InfluenzaA__ABB02950
augaauccaaaucaaaagauaauaacgauuggcucuguuucucucacuauugccacaauaugcuuccuuaugcaaauugccauccugguaacuacuguaacauugcauuucaagcaauaugaaugcgacucucucccaaacaaccaaguaaugcuaugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacagacauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacgaugggaggcuuguagauaguauugguucaugguccaaaaaaauccucaggacccaggagucugaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuccgcucagguuaugaaacuuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44968 - RNA, 1410 nt, Artificial Sequence; identical to SEQ ID NO: 44785
  neuraminidase__InfluenzaA__ABB02961

SEQ ID NO: 44969 - RNA, 1410 nt, Artificial Sequence; identical to SEQ ID NO: 44785
  neuraminidase__InfluenzaA__ABB02972

SEQ ID NO: 44970 - RNA, 1410 nt, Artificial Sequence; identical to SEQ ID NO: 44785
  neuraminidase__InfluenzaA__ABB02983

SEQ ID NO: 44971 - RNA, 1410 nt, Artificial Sequence
  neuraminidase__InfluenzaA__ABB02994
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauacuagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacagugcaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacggugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggaguaaaaggcugggcauuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44972 - RNA, 1410 nt, Artificial Sequence; identical to SEQ ID NO: 44785
  neuraminidase__InfluenzaA__ABB03005

SEQ ID NO: 44973 - RNA, 1410 nt, Artificial Sequence; identical to SEQ ID NO: 44817
  neuraminidase__InfluenzaA__ABB03016

SEQ ID NO: 44974 - RNA, 1410 nt, Artificial Sequence; identical to SEQ ID NO: 44785
  neuraminidase__InfluenzaA__ABB03027

SEQ ID NO: 44975 - RNA, 1410 nt, Artificial Sequence; identical to SEQ ID NO: 44817
  neuraminidase__InfluenzaA__ABB03038

SEQ ID NO: 44976 - RNA, 1410 nt, Artificial Sequence
  neuraminidase__InfluenzaA__ABB03049
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauacuagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacggugggaggcuuguagauaguauugguucaugguccaaaaaaauccucaggacccaggagucggaaugcguuugcaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggaguaaaaggcugggcauuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 44977 - RNA, 1410 nt, Artificial Sequence
  neuraminidase__InfluenzaA__ABB03060
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucaugauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccugguaucagaugugucugcagagacaacuggaaaggcuccaauaggcccauuguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44978 - RNA, 1410 nt, Artificial Sequence
  neuraminidase__InfluenzaA__ABB03071
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguggcauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucaugauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacaaagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44979 - RNA, 1410 nt, Artificial Sequence
  neuraminidase__InfluenzaA__ABB03093
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauagcauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauaucgaggagugcuccugcuauccucgauauccuggugucagaugugucugcagagacaacuggaaaggcuccaauaggcccauuguagauauaaacauaaaggauuauagcauuguuuccaguuaugugugcucaggacuuguaggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 44980 - RNA, 1410 nt, Artificial Sequence; identical to SEQ ID NO: 44886
  neuraminidase__InfluenzaA__ABB03104

SEQ ID NO: 44981 - RNA, 1410 nt, Artificial Sequence
  neuraminidase__InfluenzaA__ABB03115
augaauccaaaucaaaagauaauaacgauuggcucuguuucccucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauuaucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagagguaacagguccgguuauucugguauuuucucuguugaaggcaaaagcugcaucaaucggugcuuuuauguggaguugauaaggggaagaaaacaggaaaaugaagucuuguggaccucaaacaguauuguuguguuuuguggcaccucagguacauauggaacaggcucauggccugauggggcggacaucaaucucaugccuauauaa

SEQ ID NO: 44982 - RNA, 1413 nt, Artificial Sequence
  neuraminidase__InfluenzaA__ABB03126
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuuuaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 44983 - RNA, 1413 nt, Artificial Sequence
  neuraminidase__InfluenzaA__ABB03148
augaauccaaaucaaaaaauaauaaccauuggaucaaucaguauagcaaucggaacaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggggaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccugcuacccagacacuggcacagugauguguguaugcagggacaauuggcauggcucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 44984 - RNA, 1410 nt, Artificial Sequence
  neuraminidase__InfluenzaA__ABB04286
augaauccaaaucaaaagauaauaacaauuggcucugucucucucaccauugcaacaauaugcuuccuuaugcaaauugccauccugguaacuacuguaacauugcauuucaagcaauaugagugcagcucccccccaaacaaccaaguaaugccgugugaaccaauaauaauagaaaggaacauaacagagauaguguauuugacuaacaccaccauagagaaagagauaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugugauccuggcaaguguuaucaauuugcacucgggcaggggaccacacuagacaacaagcauucaaaugacacaauacaugauaggaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuguucauugaagaggggaaaaucguucauauuagcccauugucaggaagugcucagcauguagaggaguguuccuguuauccucgauauccuggugucagaugugucugcagagacaacuggaaaggcuccaauaggcccgucguagauauaaaugugaaagauuauagcauuguuuccaguuaugugugcucagggcuuguuggcgacacacccagaaaaaacgacagaucuagcaguagcuauugccggaauccuaacaaugagaaagggaaucauggagugaaaggcugggccuuugacgauggaaaugacguguggaugggaagaacgaucagcgaggagucacgcucagguuaugaaaccuucaaagucauuggugguugguccacaccuaauuccaaaucgcagauaaauaggcaagucauaguugacagcgguaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcacuucagguaccuauggaacaggcucauggccugauggagcggacaucaaucucaugccuauauaa

SEQ ID NO: 44985 - RNA, 1410 nt, Artificial Sequence
  neuraminidase__InfluenzaA__ABB04297
augaauccaaaucaaaagauaauaacaauuggcucugucucucucaccauugcaacaauaugcuuccucaugcagauugccauccugguaacuaccguaacauugcauuucaagcaauaugagugcgacucccccgcgaacaaccaaguaauuccgugugaaccaauaacaauagaaaggaacauaacagagauaguguacuugacuaacaccaccauagagaaagagauaugccccaaauuaguggaauacaggaauuggucaaagccgcaauguaaaauuacaggauuugcaccuuuuuccaaggacaauucaauucggcuuucugcugguggggacauuugggugacgagagaaccuuaugugucaugcgauccuggcaaguguuaucaauuugcacucggucaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauccucaggacccaggagucggaaugcguuuguaucaaugggacuuguacaguaguaaugacugauggaagugcaucaggaagagcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaauagcuauugccggaauccuaacaaugagaaagggaaucacggagugaaaggcugggccuuugacgauggaaaugauguguggaugggaagaacgaucagcgaggauucacgcucagguuaugaaaccuucaaagucauuggugguugguccacaccuaauuccaaauugcagauaaauaggcaagucauaguugacagcgauaauagaucagguuauucugguauuuucucuguugagggcaaaagcugcaucaauaggugcuuuuauguggaguugauaaggggaagggagcaggaaacuagaguaugguggaccucaaacaguauuguuguguuuuguggcacuucagguaccuaugggacaggcucauggccugauggggcggacaucaaucucaugccuauauaa

SEQ ID NO: 44986 - RNA, 1410 nt, Artificial Sequence
  neuraminidase__InfluenzaA__ABB04319
augaauccaaaucaaaagauaauaacaauuggcucuguuucucucaccauugccacaauaugcuuucuuaugcaaauugccauccugguaacuacuguaacauugcauuucaagcaauaugagugcagcucccccccgaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaccaauuugcacuugggcagggaaccacacuaaacaacaggcauucaaaugacacaguacaugauaggaccccuuaucgaacccucuuaaugaaugaguuggguguuccauuucauuuggggaccaagcaagugugcauagcaugguccagcucaaguugucacgauggaaaagcauggcugcauguuugugucacugggcaugauaaaaaugcaacugcuagcuucauuuacaaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucagggagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagauccagcaguagcuauugccagaauccuaacaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaaggaaacaggaaacuagagucugguggaccucaaacaguauuguuguguuuuguggcaccucagguacauauggaacaggcucauggccugauggggcggacaucaaucucaugccuauauaa

SEQ ID NO: 44987 - RNA, 1410 nt, Artificial Sequence
  neuraminidase__InfluenzaA__ABB04341
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacaggaauuggucaaagccgcaauguaaaauuacaggauuugcaccuuuuucuaaggacaauucaguucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguugggugucccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauccucaggacccaggagucggaaugcguuuguaucaaugggacuuguacaguaguaaugacugauggaagugcuucaggaagagcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaaaaacgacagaucuagcaauagcuauugccggaauccuaacaaugagaaagggaaucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 44988 - RNA, 1410 nt, Artificial Sequence
  neuraminidase__InfluenzaA__ABB04352
augaauccaaaucaaaagauaauaacaauuggcucuguuucucucaccauugcaacaauaugcuuccuuaugcaaauugccauccugguaacuacuguaacauugcauuucaagcaauaugagugcagcucccccccaaacaaccaaguaaugccgugugaaccaauaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacgagagaaccuuaugugucaugcgauccuggcaaguguuaucaauuugcacuugggcagggaaccacacuaaacaacaagcauucaaaugacacaguacaugauaggaccccuuaucgaacccucuugaugaaugaguuggguguuccauuucauuugggaaccaaacaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggaguguuccuguuauccucgauauccuggugucagaugugucugcagagacaacuggaaaggcuccaauaggcccaucguagauauaaaugugaaagauuauagcauuguuuccaguuaugugugcucagggcuuguuggcgacacacccagaaaaaacgacagauccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggugguugguccacaccuaacuccaaauugcagauaaauaggcaagucauaguugacagcgguaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcaccucagguacauauggaacaggcucauggccugauggagcggacaucaaucucaugccuauauaa

SEQ ID NO: 44989 - RNA, 1410 nt, Artificial Sequence
  neuraminidase__InfluenzaA__ABB04374
augaauccaaaucaaaagauaauaacaauuggcucugucucucucaccauugcaacaguaugcuuccucaugcagauugccauccugguaacuacuguaacauugcauuucaagcaauaugagugcgacucccccgcgaauaaccaaguaaugccgugugaaccaauaauaauagaaaggaacauaacagagauaguguauuugacuaacaccaccauagagaaagagauaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauugaugaaugaguuggguguuccauuucauuuaggaaccaggcaaguguguauagcaugguccagcucaaguugucacgauggaaaagcauggcugcauguuugugucacuggggaugaugaaaaugcaacugcuagcuucauuuacgaugggaggcuuguggacaguauugguucauggucucaaaauauccucaggacccaggagucggaaugcguuuguaucaaugggacuuguacaguaguaaugacugauggaagugcuucaggaagagcugauacuagaauacuauucauugaagaggggaaaauuguccauauuagcccauugucaggaagugcucagcauguagaggaguguuccuguuacccucgauauccuggcgucagauguaucugcagagacaacuggaaaggcucuaauaggcccgucguagauauaaaugugaaagauuauagcauugauucccguuaugugugcucagggcuuguuggcgacacacccaggaacaaugacaaaucuagcaauagcaauugcaggaauccuaacaaugauaaagggaaucauggagugaaaggcugggccuuugacgauggaaaugacguguggaugggaagaacgaucagcaaggauucacgcucagguuaugaaaccuucaaagucauuggugguugguccacaccuaauuccaaaucgcagauaaauaggcaggucauaguugacagcgauaauaggucagguuauucugguauuuucucuguugagggcaaaagcugcaucaauagaugcuuuuacguggaguugauaaggggaagggaacaggagacuaaaguaugguggaccucaaacaguauuguuguguuuuguggcacuucagguaccuaugggacaggcucauggccugauggggcggauaucaaucucaugccuauauaa

SEQ ID NO: 44990 - RNA, 1410 nt, Artificial Sequence
  neuraminidase__InfluenzaA__ABB04931
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagaaaaagagauaugccccaaauuaguggaauacaggaauuggucaaagccacaauguaaaauuacaggauuugcaccuuucucuaaggacaauucaauucggcuuucugcugguggggacauuugggugacgagagaaccuuaugugucaugcgauccuggcaaauguuaucaauuugcacucgggcaggggaccacacuagacaacaaacauucaaaugacacaauacaugauagaaccccucaucgaacccuauugaugaaugaguuggguguuccauuucacuugggaaccaggcaaguguguauagcaugguccagcucaaguugucacgauggaaaagcauggcugcauguuugugucacuggguaugauaaaaaugcaacugcuagcuucauuuacgaugggaggcuuguagacagcauugguucauggucucaaaauauccucaggacccaggagucggaauguguuuguaucaaugggacuuguacaguaguaaugacugauggaagugcuucaggaagagcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggccagucguagauauaaaugugaaagauuauagcauugauuccaguuaugugugcucagggcuuguuggcgacacacccagaaacaacgacagaucuagcaguagcuauugccggaauccuaacaaugaaaaagggaaacacggagugaaaggaugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 44991 - RNA, 1410 nt, Artificial Sequence
  neuraminidase__InfluenzaA__ABB04942
augaauccaaaucaaaagauaauaacaauuggcucuguuucucucaccauugcaacaauaugcuuccuuaugcaaauugccauccugguaacuacuguaacauugcauuucaagcaauaugagugcagcucccccccaaacaaccaaguaaugccgugugaaccaauaauaauagaaagaaacauaacagagauaguguauuugacuaacaccaccauagagaaagagauaugccccaaacuaguggaauacagaaauuggucaaagccgcaauguaaaauuacaggauuugcaccuuuuucuaaggacaauucaauucggcuuuccgcugguggggacauuugggugacgagagaaccuuaugugucaugcgauccuggcaaguguuaucaauuugcacucgggcagggaaccacacuaaacaacaagcauucaaaugacacaauacaugauaggaccccuuaucgaacccuauugaugaaugaguuggguguuccauuucauuugggaaccaagcaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggaguguuccuguuauccucgauauccuggugucagaugugucugcagagacaacuggaaaggcuccaauaggcccaucguagauauaaaugugaaagauuauagcauuguuuccaguuaugugugcucagggcuuguuggcgacacacccagaaaaaacgacagauccagcaguagcuauugccggaauccuaacaaugagaaagggaaucauggagugaaaggcugggccuuugacgauggaaaugacguguggaugggaagaacgauuggcgaggaguuacgcucagguuaugaaaccuucaaagucauuggugguugguccacaccuaacuccaaauugcagauaaauaggcaagucauaguugacagcgauaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcaccucagguacauauggaacaggcucauggccugauggagcggacaucaaucucaugccuauauaa

SEQ ID NO: 44992 - RNA, 1410 nt, Artificial Sequence
  neuraminidase__InfluenzaA__ABB04953
augaauccaaaucaaaagauaauaacaauuggcucuguuucucucaccauugcaacaauaugcuuccuuaugcaaauugccauccugguaacuacuguaacauugcauuucaagcaauaugagugcagcucccccccaaacaaccaaguaaugccgugugaaccaauaauaaucgaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacgagagaaccuuaugugucaugcgauccuggcaaguguuaucaauuugcacuugggcagggaaccacacuaaacaacaagcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggaguguuccuguuauccucgauauccuggugucagaugugucugcagagacaacuggaaaggcuccaauaggcccaucguagauauaaaugugaaagauuauagcauuguuuccaguuaugugugcucagggcuuguuggcgacacacccagaaaaaacgacagauccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggugguugguccacaccuaacuccaaauugcagauaaauaggcaagucauaguugacagcgguaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcaccucagguacauauggaacaggcucauggccugauggagcggacaucaaucucaugccuauauaa

SEQ ID NO: 44993 - RNA, 1410 nt, Artificial Sequence; identical to SEQ ID NO: 44889
  neuraminidase__InfluenzaA__ABB04975

SEQ ID NO: 44994 - RNA, 1410 nt, Artificial Sequence
  neuraminidase__InfluenzaA__ABB04986
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauccggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggaucauagcauuguuuccaguuaugugugcucaggacuuguuggagacacacccagaaaaaacgacagcuucagcaguagccauugccuagacccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 44995 - RNA, 1410 nt, Artificial Sequence
  neuraminidase__InfluenzaA__ABB04997
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauagugcaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaagccuauauaa

SEQ ID NO: 44996 - RNA, 1410 nt, Artificial Sequence
  neuraminidase__InfluenzaA__ABB05008
augaauccaaaucaaaagauaauaacgauuggcucuguuucucucaccauugcuacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgacccugacaaguguuaucaauuugcccuuggacaaggaacaacacuaaacaacgggcauucaaaugacacaguacaugauaggaccccuuaucgaacccuauugaugaaugaguuggguguuccauuucauuugggaaccaaacaagugugcauagcaugguccagcucaaguugucacgauggaaaagcauggcugcauguuuguguaacgggggaugaugaaaaugcaacagcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44997 - RNA, 1410 nt, Artificial Sequence; identical to SEQ ID NO: 44725
  neuraminidase__InfluenzaA__ABB05186

SEQ ID NO: 44998 - RNA, 1410 nt, Artificial Sequence
  neuraminidase__InfluenzaA__ABB05219
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucaauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugauggaagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 44999 - RNA, 1410 nt, Artificial Sequence
  neuraminidase__InfluenzaA__ABB46395
augaauccaaaucaaaagauaauaacaauuggcucugucucucucaccauugcaacaauaugcuuccucaugcagauugccauccugguaacuacuguaacauugcauuucaagcaauaugagugcgacuccccagcgaacaaacaaguaaugccgugugaaccaauaauaauagaaaggaacauaacagagauaguguauuugacuaacaccaccauagaaaaagagauaugccccaaauuaguggaauacaggaauuggucaaagccacaauguaaaauuacaggauuugcaccuuucucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucacuugggaaccaggcaaguguguauagcaugguccagcucaaguugucacgauggaaaagcauggcugcauguuugugucacuggguaugauaaaaaugcaacugcuagcuucauuuacgaugggaggcuuguagacagcauugguucauggucucaaaauauccucaggacccaggagucggaauguguuuguaucaaugggacuuguacaguaguaaugacugauggaagugcuucaggaagagcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggccagucguagauauaaaugugaaagauuauagcauugauuccaguuaugugugcucagggcuugugggcgacacacccagaaacaacgacagaucuagcaguagcuauugccggaauccuaacaaugaaaaagggacucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuuuucuguugagggcaaaagcugcaucaauaggugcuuuuauguggagcugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 45000 - RNA, 1410 nt, Artificial Sequence
  neuraminidase__InfluenzaA__ABB46417
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauuacagagauaguguaccugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuccgcucagguuaugaaaccuucaaagucauugaaggcugguccaaaccuaacucuaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaaguaugguggaccucaaacaguauuguuguguuuuguggcaccucagguacauauggaacaggcucauggccugauggggcggacaucaaucucaugccuauauaa

SEQ ID NO: 45001 - RNA, 1410 nt, Artificial Sequence
  neuraminidase__InfluenzaA__ABB46428
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagcgcuucaggaaaagcugauacuaaaauacuauucauugaggaggggaaaaucguucauauuagcccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 45002 - RNA, 1410 nt, Artificial Sequence
  neuraminidase__InfluenzaA__ABB46439
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuucugcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggagcuuguacaguaguaaugacugaugggagugcuucaggaaaagcugauacuaaaauacuauucauugaggagaggaggaucguucauacuagcacauugucaggaagugcucagcaugucgaggagugcuccugcuauccucgauauccuggugucagaugugucugcagagacaacuggaaaggguccaauaggcccaucguagauauaaacauaaaggauuauagcauuguuuccaguuaugugugcucaggacuuguuggagacacacccagaaaaaacgacagcuccagcaguagcaauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucgggugcauauggaacaggcucauggccugauggggcggacaucaaucucaugccuauauaa

SEQ ID NO: 45003 - RNA, 1410 nt, Artificial Sequence; identical to SEQ ID NO: 44850
  neuraminidase__InfluenzaA__ABB46450

SEQ ID NO: 45004 - RNA, 1410 nt, Artificial Sequence
  neuraminidase__InfluenzaA__ABB46461
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaaugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaagguugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45005 - RNA, 1410 nt, Artificial Sequence
  neuraminidase__InfluenzaA__ABB46550
augaauccaaaucaaaagauaauaacaauuggcucugucucucucaccauugcaacaauaugcuuccuuaugcaaauugccauccugguaacuacuguaacauugcauuucaagcaauaugagugcagcucccccccaaacaaccaaguaaugccgugugaaccaauaauaauagaaaggaacauaacagagauaguguauuugacuaacaccaccauagagaaagagauaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugugauccuggcaaguguuaucaauuugcacucgggcaggggaccacacuagacaacaagcauucaaaugacacaauacaugauaggaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucaugguccaaaaauauccucaggacccaggagucggaaugcguuugugucaaugggacuuguacaguaguaaugacugauggaagugcuucagaaagagcugauacuaaaauacuguucauugaagaggggaaaaucguucauauuagcccauugucaggaagugcucagcauguagaggaguguuccuguuauccucgauauccuggugucagaugugucugcagagacaacuggaaaggcuccaauaggcccgucguagauauaaaugugaaagauuauagcauuguuuccaguuaugugugcucagggcuuguuggcgacacacccagaaaaaacgacagaucuagcaguagcuauugccggaauccuaacaaugagaaagggaaucauggagugaaaggcugggccuuugacgauggaaaugacguguggaugggaagaacgaucagcgaggagucacgcuccgguuaugaaaccuucaaagucauuggugguugguccacaccuaauuccaaaucgcagauaaauaggcaagucauaguugacagcgguaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcacuucagguaccuauggaacaggcucauggccugauggagcggacaucaaucucaugccuauauaa

SEQ ID NO: 45006 - RNA, 1410 nt, Artificial Sequence
  neuraminidase__InfluenzaA__ABB51955
augaauccaaaucaaaagauaauaacgauuggcucuguuucucucaccauuuccacaauaugcuucuuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaauguuaucaauuugcccuuggacagggaacaacacuaaacaacgggcauucaaaugacauaguacaugauaggaccccuuaucggacccuauugaugaaugaguuggguguuccauuucaucuggggaccaagcaagugugcauagcaugguccagcucaaguugucaugauggaaaagcauggcugcauguuuguguaacgggggaugaugaaaaugcaacugcuagcuucauuuacaaugggaggcuuguagauaguauugguucaugguccaaaaaauucuucaggacucaggagucagaaugcguuuguauccauggaacuuguacaguaguaaugacugaugggagugcuucaagaaaagccgauacuaaaauacuauucaucgaggaggggaaaaucguucauaccagcacauugucaggaagugcucagcaugucgaggagugcuccuguuauccucgauauccuggugucagaugugucugcagagacaacuggaaaggcuccaauaggcccaucguagauauaaauauaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcacuucagguacauauggaacaggcucauggccugauggggcggacaucaaucucaugccuauauaa

SEQ ID NO: 45007 - RNA, 1413 nt, Artificial Sequence
  neuraminidase__InfluenzaA__ABB51956
augaauccaaaucaaaaaauaauaaccauuggaucaaucaguauagcaaucggaauaauuagccuaauguugcaaauaggaaacauuauuucaauaugggcuagucacucaauccaaacuggaagucaaaaucacacuggaguaugcaaccaaagaaucaucacauaugaaaacagcaccugggugaaucacacauauguuaauauuaacaacaccaauguuauugcuggaaaggacaaaacuucagugacaguggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucugggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagccaauauuaggaacccaagagucugaaugggucugugugaacgggucauguuucaccauaaugaccgaugacccgaguuaugaggccgccucguacaaaaucuucaagaucgaaagggaaaggguuacuaaaucaauagaguugaaugcacccaauuuucauuaugaggaauguuccuguuacccagacacuggcacagugauguguguaugcagggacaacuggcaugguucaaaucgacccuggguguccuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguaa

SEQ ID NO: 45008 - RNA, 1410 nt, Artificial Sequence
  neuraminidase__InfluenzaA__ABB51957
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacgugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauauucagaacccagaaguucgaaugcguuuguauccauuggaccuguacaguaguuaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggagcggacaucaaucucaugccuauauaa

SEQ ID NO: 45009 - RNA, 1413 nt, Artificial Sequence
  neuraminidase__InfluenzaA__ABB51958
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaguauuaacaacaccaauguuauugcuggaaaggacaaaacuucagugacauuggccggcaauucaucucuuuguccuauccguggaugggcuauauacacaaaaggcaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucggcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaggagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguucccguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguugggauaggaaggacuauaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguaa

SEQ ID NO: 45010 - RNA, 1410 nt, Artificial Sequence
  neuraminidase__InfluenzaA__ABB51959
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaaggaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugguaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucaaugaggaggggaaaaucguucauacuagcacauguucaggaagugcccagcaugucgaggagugcucuugcuauucucgauauccuggugucagaugugucugcagagacaacuggaaaggcuccaauagacccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggccgggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45011 - RNA, 1413 nt, Artificial Sequence
  neuraminidase__InfluenzaA__ABB51960
augaauccaaaucaaaaaauaauaaccauuggaucaaucaguauagcaaucggaauaauuagccuaauguugcaaauaggaaacauuauuccaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuuuugacccaaggugcucuauuaaaugacaaacauucaaaugggaccguuaaggacagaagccccuauagggcuuuaaugagcuguccucuaggugaagcuccguccccauacaauucagaguuugaaucaguugcuuggucggcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaggagucugaaugugucugugugaacgggucauguuucaccauaaugaccgauggcccgaguaauggggccgccucguacaaaaucuucaagaucgaaaagggaaagauuacuaaaucaauagaguugaaugcgcccaauucucauuaugaggaauguuccuguuacccagacacuggcacagugauguguguaugcagggacagcuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacgaauaugguaauggugauuggauaggaaggacuaaaaguaacagacuuagaaagggguuugagaugauuugggauccugauggauggacagauaccaacagugauuucucagugaaacaggauguuguggcaauaacugauuggucuggguacagcggaaguuucguucaacauccugaguuaacaggauuggucuguauaagaccuugcuucuggguugaguuagucagaggacugccaaaggaaaauacaacaaucuggacuagugggagcagcauuucuuuuuguggcguaaauagugauacugcaaacuggucuuggccagacggugcugaguugccguuuaccauugacaaguaa

SEQ ID NO: 45012 - RNA, 1410 nt, Artificial Sequence; identical to SEQ ID NO: 44847
  neuraminidase__InfluenzaA__ABB53617

SEQ ID NO: 45013 - RNA, 1410 nt, Artificial Sequence
  neuraminidase__InfluenzaA__ABB53721
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccucugguggggacaucugggugacaagagagccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcggauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45014 - RNA, 1410 nt, Artificial Sequence
  neuraminidase__InfluenzaA__ABB53754
augaauccaaaucaaaagauaauaacaauuggcucugucucucucaccauugcaacaauaugcuuccuuaugcaaauugccauccugguaacuacuguaacacugcauuucaagcaauaugagugcagcucccccccaaacaaccaaguaaugccgugugaaccaauaauaauagaaaggaacauaacagagauaguguauuugacuaacaccaccauagagaaagagauaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaagcauucaaaugacacaauacaugauaggaccccucaucgaacccuauugaugaaugaguugggugucccauuucauuugggaaccaggcaaguguguauagcaugguccagcucaaguugucacgauggaaaagcauggcugcauguuugugucacuggguaugauaaaaaugcaacugcuagcuucauuuaugaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggaguguuccuguuauccucgauauccuggugucagaugugucugcagagacaacuggaaaggcuccaauaggcccgucguagauauaaaugugaaagauuauagcauuguuuccaguuaugugugcucagggcuuguuggcgacacacccagaaaaaacgacagaucuagcaguagcuauugccggaauccuaacaaugagaaagggaaucauggagugaaaggcugggccuuugacgauggaaaugacguguggaugggaagaacgaucagcgaggagucacgcucagguuaugaaaccuucaaagucauuggugguugguccacaccuaauuccaaauugcagauaaauaggcaagucauaguugacagcgauaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcacuucagguaccuauggaacaggcucauggccugauggagcggacaucaaucucaugccuauauaa

SEQ ID NO: 45015 - RNA, 1410 nt, Artificial Sequence; identical to SEQ ID NO: 44607
  neuraminidase__InfluenzaA__ABB54517

SEQ ID NO: 45016 - RNA, 1410 nt, Artificial Sequence
  neuraminidase__InfluenzaA__ABB59999
augaauccaaaucaaaagauaauaacgauuggcucuguuucucucacuauugccacaauaugcuuccuuaugcaaauugccauccugguaacuacuguaacauugcauuucaagcaauaugaaugcagcucucccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagggaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauuuauugaggaggggaaaaucguucauaucagcccacuaucaggaagugcucagcaugucgaggagugcuccuguuauccucgauauccuggugucagaugugucugcagagacaacuggaaaggcuccaauaggcccaucguagauauaaauauaaaggauuauagcauuguuuccaguuaugugugcucaggacuuguuggagacacacccagaaaaaacgacagcuccagcaguagucauugccugaauccuaacaaugaggaagggggucauggagugaaaggcugggccuuugaugauggaaaugacguguggaugggaagaacaaucagcgagaaguuccgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuacguuuuguggcaccucagguacauauggaacaggcucauggccugauggggcggacaucaaucucaugccuauauaa

SEQ ID NO: 45017 - RNA, 1410 nt, Artificial Sequence
  neuraminidase__InfluenzaA__ABB60010
augaauccaaaucaaaagauaauaacgauuggcucuguuucucucacuauugccacaauaugcuuccuuaugcaaauugccauccugguaacuacuguaacauugcauuucaagcaauaugaauacagcucucccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauuaggcuuuccgcugguggggacauuugggugacaagggaaccuuaugugucaugcgauccugacaaguguuaucaauuugcccuuggacagggaacaacacuaaacaacaggcauucaaaugacacagugcaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauaucagcccacugucaggaagugcucagcaugucgaggagugcuccuguuauccucgauauccuggugucagaugugucugcagagacaacuggaaaggcuccaauaggcccaucguagauauaaauguaaaggauuauagcauuguuucccguuaugugugcucaggacuuguuggagacacacccagaaaaaacgacagcuccagcaguagucauugccugaauccuaacaaugaggaagggggucauggagugaaaggcugggccuuugaugauggaaaugacguguggaugggaagaacgaucagcgaaaaguuccgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcacaucagguacauauggaacaggcucauggccugauggggcggacaucaaucucaugccuauauaa

SEQ ID NO: 45018 - RNA, 1410 nt, Artificial Sequence
  neuraminidase__InfluenzaA__ABB77867
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucaaaggacaauucaauucggcuuuccgcugguggggacauuugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuuaggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagccaauugucaggaagugcucagcaugucgaggagugcuccuguuauccucgauauccuggugucagaugugucugcagagacaacuggaaaggcuccaauaggcccaucguagauauaaauguaaaggaucauagcauuguuuccaguuaugugugcucaggacuuguuggagacacacccagaaaaaacgacagcuccagcaguagccauugccugaauccuaacaaugaagaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuugugguaccucagguacauauggaacaggcucauggccugauggggcggacaucaaucucaugccuauauaa

SEQ ID NO: 45019 - RNA, 1410 nt, Artificial Sequence
  neuraminidase__InfluenzaA__ABB79719
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucaaaggacaauucaauucggcuuuccgcugguggggacauuugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuuaggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagccaauugucaggaagugcucagcaugucgaggagugcuccuguuauccucgauauccuggugucagaugugucugcagagacaacuggaaaggcuccaauaggcccaucguagauauaaauguaaaggaucauagcauuguuuccaguuaugugugcucaggacuuguuggagacacacccagaaaaaacgacagcuccagcaguagccauugccugaauccuaacaaugaagaagggggucauggagugaaaggcugggccuuugaugauggaaaugacguguggaugggaagaacgaucagcgagaaguuacgcucagguuaugaaaccuucaaagucauugaaggcugguccaaacccaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuugugguaccucagguacauauggaacaggcucauggccugauggggcggacaucaaucucaugccuauauaa

SEQ ID NO: 45020 - RNA, 1410 nt, Artificial Sequence
  neuraminidase__InfluenzaA__ABB79734
augaauccaaaucaaaagauaauaacgauuggcucuguuucucucacccuuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacaucacaggauuugcaccuuuuucuaaggacaauucgauuaggcuuuccgcugguggggacaucugggugacaagagaaccuuaugugucaugcgauccugacaaguguuaucaauuugcccucggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauauuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacguucaggauaugaaacuuucaaagucauugaaggcugguccaacccuaauucuaaauugcagauaaauaggcaagucauaguugacagagguaauagguccgguuauucugguauuuucucuguugaaggcaaaagcugcaucaaucgaugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45021 - RNA, 1410 nt, Artificial Sequence
  neuraminidase__InfluenzaA__ABB79791
augaauccaaaucaaaagauaauaacaauuggcucuguuucucucaccauugcaacaauaugcuuccuuaugcaaauugccauccugguaacuacuguaacauugcauuucaagcaauaugagugcagcucccccccaaacaaccaaguaaugccgugugaaccaauaauaauagaaagaaacauaacagagauaguguauuugacuaacaccaccauagagaaagagauaugccccaaacuaguggaauacagaaauuggucaaagccgcaauguaaaauuacaggauuugcaccuuuuucuaaggacaauucaauucggcuuuccgcugguggggacauuugggugacgagagaaccuuaugugucaugcgauccuggcaaguguuaucaauuugcacuugggcagggaaccacacuaaacaacaagcauucaaaugacacaauacaugauaggaccccuuaucgaacccuauugaugaaugaguuggguguuccauuucauuugggaaccaagcaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggaguguuccuguuauccucgauauccuggugucagaugugucugcagagacaacuggaaaggcuccaauaggcccaucguagauauaaaugugaaagauuauagcauuguuuccaguuaugugugcucagggcuuguuggcgacacacccagaaaaaacgacagauccagcaguagcuauugccggaauccuaacaaugagaaagggaaucauggagugaaaggcugggccuuugacgauggaaaugacguguggaugggaagaacgauuggcgaggaguuacgcucagguuaugaaaccuucaaagucauuggugguugguccacaccuaacuccaaauugcagauaaauaggcaagucauaguugacagcgauaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcaccucagguacauauggaacaggcucauggccugauggagcggacaucaaucucaugccuauauaa

SEQ ID NO: 45022 - RNA, 1410 nt, Artificial Sequence
  neuraminidase__InfluenzaA__ABB79802
augaauccaaaucaaaagauaauaacaauuggcucuguuucucucaccauugcaacaauaugcuuccuuaugcaaauugccauccugguaacuacuguaacauugcauuucaagcaauaugagugcagcucccccccaaacaaccaaguaaugccgugugaaccaauaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacgagagaaccuuaugugucaugcgauccuggcaaguguuaucaauuugcacuugggcagggaaccacacuaaacaacaagcauucaaaugacacaauacaugauaggaccccuuaucgaacccucuuaaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggaguguuccuguuauccucgauauccuggugucagaugugucugcagagacaacuggaaaggcuccaauaggcccaucguagauauaaaugugaaagauuauagcauuguuuccaguuaugugugcucagggcuuguuggcgacacacccagaaaaaacgacagauccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggugguugguccacaccuaacuccaaauugcagauaaauaggcaagucauaguugacagcgguaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcaccucagguacauauggaacaggcucauggccugauggagcggauaucaaucucaugccuauauaa

SEQ ID NO: 45023 - RNA, 1410 nt, Artificial Sequence
  neuraminidase__InfluenzaA__ABB79813
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaguaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcacucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaauuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45024 - RNA, 1410 nt, Artificial Sequence; identical to SEQ ID NO: 45023
  neuraminidase__InfluenzaA__ABB79960

SEQ ID NO: 45025 - RNA, 1410 nt, Artificial Sequence; identical to SEQ ID NO: 45023
  neuraminidase__InfluenzaA__ABB79971

SEQ ID NO: 45026 - RNA, 1413 nt, Artificial Sequence
  neuraminidase__InfluenzaA__ABB79982
augaaugcaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45027 - RNA, 1413 nt, Artificial Sequence
  neuraminidase__InfluenzaA__ABB79993
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaguagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcaaauggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuaaagaaaauacaacaaucuggacuagugggagcagcauuucuuuuuguggcguaaauagugauacugcaaacuggucuuggccagacggugcugaguugccguucaccauugacaaguag

SEQ ID NO: 45028 - RNA, 1410 nt, Artificial Sequence
  neuraminidase__InfluenzaA__ABB80004
augaauccaaaucaaaagauaauaacgauuggcucuguuucucucaccauuucuacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacaggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggccaaucguagauauaaacauaaaggauuauagcacuguuuccaguuaugugugcucaggacuuguuggagacacacccagaaaaaacgacagcuccagcaguagccauugcuuggauccuaacaacgaagaagguggucauggagugaaaggcugggccuuugaugauggaaaugacguguggaugggaagaacgaucagcgagaaguuacgcucgggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45029 - RNA, 1410 nt, Artificial Sequence
  neuraminidase__InfluenzaA__ABB80015
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccucugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcggauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45030 - RNA, 1410 nt, Artificial Sequence
  neuraminidase__InfluenzaA__ABB80037
augaauccaaaucaaaagauaauaacaauuggcucugucucucucaccauugcaacaguaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugaauaacaccaccauagagaaagagauaugccccaaauuaguggaauacagaaauuggucaaagccgcaauguaaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauugaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuaugacgggaggcuuguggacaguauugguucauggucucaaaauauccucaggacccaggagucagaaugcguuuguaucaaugggacuuguacaguaguaaugacugauggaagugcuucaggaagagcugauacuagaauacuauucauugaagaggggaaaauuguccauauuagcccauugucaggaagugcucagcauguagaggaguguuccuguuauccucgauauccuggcgucagauguaucugcagagacaacuggaaaggcucuaauaggcccgucguagauauaaauguggaagauuauagcauugauuccaguuaugugugcucagggcuuguuggcgacacacccagaaacaacgacagaucuagcaauagcaauugcaggaauccuaacaaugagagagggaaucacggagugaaaggcugggccuuugacgauggaaaugacguauggaugggaagaacgaucagcaaggauuuacgcucagguuaugaaaccuucaaagucauuggugguugguccacaccuaauuccaaaucgcagauaaauaggcaagucauaguugacagcgauaauaggucagguuauucugguauuuucucuguugagggcaaaagcugcaucaauaggugcuuuuauguggaguugauaaggggaagggaacaggagacuagaguaugguggaccucaaacaguauuguuguguuuuguggcacuucagguacauauggaacaggcucauggccugauggggcggacaucaaucucaugccuauauaa

SEQ ID NO: 45031 - RNA, 1413 nt, Artificial Sequence
  neuraminidase__InfluenzaA__ABB80048
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaguagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcaaauggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuaaagaaaauacaacaaucuggacuagugggagcagcauuucuuuuuguggcguaaauggugauacugcaaacuggucuuggccagacggugcugaguugccguucaccauugacaaguag

SEQ ID NO: 45032 - RNA, 1410 nt, Artificial Sequence
  neuraminidase__InfluenzaA__ABB80084
augaauccaaaucaaaagauaauaacgauuggcucuguuucucucacuauugccacaauaugcuuccuuaugcaaauugccauccugguaacuacuguaacauugcauuucaagcaauaugaaugcaacucccccucaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucaaaggacaauucaauucggcuuuccgcugguggggacauuugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuuaggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagccaauugucaggaagugcucagcaugucgaggagugcuccuguuauccucgauauccuggugucagaugugucugcagagacaacuggaaaggcuccaauaggcccaucguagauauaaauguaaaggaucauagcauuguuuccaguuaugugugcucaggacuuguuggagacacacccagaaaaaacgacagcuccagcaguagccauugccugaauccuaacaaugaagaagggggucauggagugaaaggcugggccuuugaugauggaaaugacguguggaugggaagaacgaucagcgagaaguuacgcucagguuaugaaaccuucaaagucauugaaggcugguccaaacccaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuugugguaccucagguacauauggaacaggcucauggccugauggggcggacaucaaucucaugccuauauaa

SEQ ID NO: 45033 - RNA, 1410 nt, Artificial Sequence; identical to SEQ ID NO: 45018
  neuraminidase__InfluenzaA__ABB80095

SEQ ID NO: 45034 - RNA, 1410 nt, Artificial Sequence
  neuraminidase__InfluenzaA__ABB80162
augaauccaaaucaaaagauaauaacgauuggcucuguuucucucacuauugccacaauaugcuuccuuaugcaaauugccauccugguaacuacuguaacauugcauuucaagcaauaugaaugcaacucccccccgaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucaaaggacaauucaauucggcuuuccgcugguggggacauuugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuuaggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagccaauugucaggaagugcucagcaugucgaggagugcuccuguuauccucgauauccuggugucagaugugucugcagagacaacuggaaaggcuccaauaggcccaucguagauauaaauguaaaggaucauagcauuguuuccaguuaugugugcucaggacuuguuggagacacacccagaaaaaacgacagcuccagcaguagccauugccugaauccuaacaaugaagaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuugugguaccucagguacauauggaacaggcucauggccugauggggcggacaucaaucucaugccuauauaa

SEQ ID NO: 45035 - RNA, 1410 nt, Artificial Sequence
  neuraminidase__InfluenzaA__ABB80199
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagaaauaguguaucugaccaacaccaccauagagaaggaaauaugccccaaacuagcagaauacagaaauuggucaaagccacaauguaaaauuacaggauuugcaccuuuuucaaaggacaauucaauucggcuuuccgcugguggggacauuugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuuaggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagccaauugucaggaagugcucagcaugucgaggagugcuccuguuauccucgauauccuggugucagaugugucugcagagacaacuggaaaggcuccaauaggcccaucguagauauaaauguaaaggaucauagcauuguuuccaguuaugugugcucaggacuuguuggagacacacccagaaaaaacgacagcuccagcaguagccauugccugaauccuaacaaugaagaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuugugguaccucagguacauauggaacaggcucauggccugauggggcggacaucaaucucaugccuauauaa

SEQ ID NO: 45036 - RNA, 1410 nt, Artificial Sequence
  neuraminidase__InfluenzaA__ABB80210
augaauccaaaucaaaagauaauaacgauuggcucuguuucucucacuauugccacaauaugcuuccuuaugcaaauugccauccugguaacuacuguaacauugcauuucaagcaauaugaaugcagcucucccccaaacaaccaaguaaugcugugugaaccaacaauaauagaaagaaacauaacagagauaguguaucugaccaacaccaccauagagaaggaaauaugccccaaacuagcagaauacagaaauuggucaaagccacaauguaaaauuacaggauuugcaccuuuuucuaaggacaauucaauucggcuuuccgcugguggggacauuugggugacaagggaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguuacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauaucagcccacuaucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagucauugccugaauccuaacaaugaggaagggggucauggagugaaaggcugggccuuugaugauggaaaugacguguggaugggaagaacaaucagcgagaaguuccgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucggucucaugccuauauaa

SEQ ID NO: 45037 - RNA, 1410 nt, Artificial Sequence
  neuraminidase__InfluenzaA__ABB80232
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuugccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagccaauugucaggaagugcucagcauguugaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccugaauccuaacaaugaagaagggggucauggagugaaaggcugggccuuugaugauggagaugacguguggaugggaagaacgaucagcgagaaguuacgcucagguuaugaaaccuucaaagucauugagggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcacuucagguacauauggaacaggcucauggccugauggggcggacaucaaucucaugccuauauaa

SEQ ID NO: 45038 - RNA, 1410 nt, Artificial Sequence
  neuraminidase__InfluenzaA__ABB80243
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucaaaggacaauucaauucggcuuuccgcugguggggacauuugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuuaggaaccaagcaagugugcauagcaugguccagcucaaguugucacgauggaaaagcauggcugcauguuuguguaacugggcaugaugaaaaugcaacugcuagcuucauuuacgaugggaggcuuguagacaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagccaauugucaggaagugcucagcaugucgaggagugcuccuguuauccucgauauccuggugucagaugugucugcagagacaacuggaaaggcuccaauaggcccaucguagauauaaauguaaaggaucauagcauuguuuccaguuaugugugcucaggacuuguuggagacacacccagaaaaaacgacagcuccagcaguagccauugccugaauccuaacaaugaagaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaaaaggaaaaugaagucugguggaccucaaacaguauuguuguguuuugugguaccucagguacauauggaacaggcucauggccugauggggcggacaucaaucucaugccuauauaa

SEQ ID NO: 45039 - RNA, 1410 nt, Artificial Sequence
  neuraminidase__InfluenzaA__ABB80254
augaauccaaaucaaaagauaauaacgauuggcucuguuucucucacuauugccacaauaugcuuccuuaugcaaauugccauccugguaacuacuguaacauugcauuucaagcaauaugaaugcagcucucccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagggaaccuuaugugucaugcgguccugacaaguguuaucaauuugcccuuggacagggaacaacacuaaacaacaggcauucaaaugacacagugcaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaauuuguacaguaguaaugacugaugggagugcuucaggaagagcugauacuaaaauacuauucauugaggaggggaaaaucguucauaucagcccacugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagucauugccugaauccuaacaaugaggaagggggucauggagugaaaggcugggccuuugaugauggaaaugacguguggaugggaagaacgaucagcgaaaaguuccgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcacaucagguacauauggaacaggcucauggccugauggggcggacaucaaucucaugccuauauaa

SEQ ID NO: 45040 - RNA, 1410 nt, Artificial Sequence
  neuraminidase__InfluenzaA__ABB80495
augaauccaaaucaaaagauaauaacgauuggcucuguuucucucacuauugccacaauaugcuuccuuaugcaaauugccauccugguaacuacuguaacauugcauuucaagcaauaugaaugcagcucucccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagggaaccuuaugugucaugugauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaaccuguacaguaguaaugacugaugggagugcuucaggaagagcugauacuaaaauacuauucauugaggaggggaaaaucguucauaucagcccacugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagucauugccugaauccuaacaaugaggaagggggucauggagugaaaggcugggccuuugaugauggaaaugacguguggaugggaagaacaaucagcgagaaguuccgcucagguuaugaaaccuucaaagucauugaaggcugguccaaaccuaacuccaaauugcagauaaauaggcaagucauaguugacagagguaauaggucugguuauucugguauuuucucuguugaaggcaaaagcugcaucaaucggugcuuuuauguggaguugauaaggggaaggaaacaggaaacugaagucugguggaccucaaacaguauuguugcguuuuguggcaccucagguacauauggaacaggcucauggccugauggggcggacaucaaucucaugccuauauaa

SEQ ID NO: 45041 - RNA, 1410 nt, Artificial Sequence
  neuraminidase__InfluenzaA__ABB80506
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucaaaggacaauucaauucggcuuuccgcugguggggacauuugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuuaggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagccaauugucaggaagugcucaacaugucgaggagugcuccuguuauccucgauauccuggugucagaugugucugcagagacaacuggaaaggcuccaauaggcccaucguagauauaaauguaaaggaucauagcauuguuuccaguuaugugugcucaggacuuguuggagacacacccagaaaaaacgacagcuccagcaguagccauugccugaauccuaacaaugaagaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuugugguaccucagguacauauggaacaggcucauggccugauggggcggacaucaaucucaugccuauauaa

SEQ ID NO: 45042 - RNA, 1410 nt, Artificial Sequence; identical to SEQ ID NO: 45018
  neuraminidase__InfluenzaA__ABB80517

SEQ ID NO: 45043 - RNA, 1410 nt, Artificial Sequence; identical to SEQ ID NO: 45018
  neuraminidase__InfluenzaA__ABB80532

SEQ ID NO: 45044 - RNA, 1410 nt, Artificial Sequence
  neuraminidase__InfluenzaA__ABB80644
augaauccaaaucaaaagauaauaacgauuggcucuguuucucucacuauugccacaauaugcuuccuuaugcaaauugccauccugguaacuacuguaacauugcauuucaagcaauaugaaugcagcucucccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagggaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaacaaaauccucaggacccaggagucggaaugcguuuguaucaauggaacuuguacaguaguaaugacugaugggagugcuucaggaagagcugauacuaaaauacuauucauugaggaggggaaaaucguucauaucagcccacugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagucauugccugaauccuaacaaugaggaagggggucauggagugaaaggcugggccuuugaugauggaaaugacguguggaugggaagaacgaucagcgagaaguuccgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45045 - RNA, 1410 nt, Artificial Sequence
  neuraminidase__InfluenzaA__ABB80664
augaauccaaaucaaaagauaauaacgauuggcucuguuucucucacuauugccacaauaugcuuccuuaugcaaauugccauccugguaacuacuguaacauugcauuucaagcaauaugaaugcagcucucccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagggaaccuuaugugucgugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuugcaucaauggaacuuguacaguaguaaugacugaugggagugcuucaggaagagcugauacuaaaguacuauucauugaggaggggaaaaucguucauaucagcccacugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagucauugccugaauccuaacaaugaggaagggggucauggagugaaaggcugggccuuugaugauggaaaugacguguggaugggaagaacgaucagcgagaaguuccgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45046 - RNA, 1410 nt, Artificial Sequence
  neuraminidase__InfluenzaA__ABB80675
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuugccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuugugugacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagccaauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagcuauugccugaauccuaacaaugaagaagggggucauggagugaaaggcugggccuuugaugauggggaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45047 - RNA, 1410 nt, Artificial Sequence
  neuraminidase__InfluenzaA__ABB80685
augaauccaaaucaaaagauaauaacgauuggcucuguuucucucacuauugccacaauaugcuuccuuaugcaaauugccauccugguaauuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucaaaggacaauucaauucggcuuuccgcugguggggacauuugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuuaggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugggucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagccaauugucaggaagugcucagcaugucgaggagugcuccuguuauccucgauauccuggugucagaugugucugcagagacaacuggaaaggcuccaauaggcccaucguagauauaaauguaaaggaucauagcauuguuuccaguuaugugugcucaggacuuguuggagacacacccagaaaaaacgacagcuccagcaguagccauugccugaauccuaacaaugaagaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuugugguaccucagguacauauggaacaggcucauggccugauggggcggacaucaaucucaugccuauauaa

SEQ ID NO: 45048 - RNA, 1410 nt, Artificial Sequence; identical to SEQ ID NO: 45035
  neuraminidase__InfluenzaA__ABB80696

SEQ ID NO: 45049 - RNA, 1410 nt, Artificial Sequence
  neuraminidase__InfluenzaA__ABB80707
augaauccaaaucaaaagauaauaacgauuggcucuguuucucucacuauugccacaauaugcuuccuuaugcaaauugccauccugguaacuacuguaacauugcauuucaagcaauaugaaugcagcucucccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagggaaccuuaugugucgugcgguccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauaucagcccacugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagucauugccugaauccuaacaaugaggaagggggucauggagugaaaggcugggccuuugaugauggaaaugacguguggaugggaagaacgaucagcgagaaguuccgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45050 - RNA, 1410 nt, Artificial Sequence; identical to SEQ ID NO: 45018
  neuraminidase__InfluenzaA__ABB80716

SEQ ID NO: 45051 - RNA, 1410 nt, Artificial Sequence
  neuraminidase__InfluenzaA__ABB80725
augaauccaaaucaaaagauaauaacgauuggcucuguuucucucacuauugccacaauaugcuuccuuaugcaaauugccauccugguaacuacuguaacauugcauuucaagcaauaugaaugcagcucucccccaaacaaccaaguaaugcugugugaaccaacaguaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagggaaccuuaugugucaugcgacccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauauuauucauugaggaggggaaaaucguucauaucagcccacugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagucauugccugaauccuaacaaugaggaagggggucauggagugaaaggcugggccuuugaugauggaaaugacguguggaugggaagaacaaucagcgagaaguuccgcucagguuaugaaaccuucaaagucauugaaggcugguccaaaccuaacuccaaauugcaaauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguugcguuuuguggcaccucagguacauauggaacaggcucauggccugauggggcggacaucaaucucaugccuauauaa

SEQ ID NO: 45052 - RNA, 1410 nt, Artificial Sequence
  neuraminidase__InfluenzaA__ABB80740
augaauccaaaucaaaagauaauaacgauuggcucuguuucucucacuauugccacaauaugcuuccuuaugcaaauugccauccugguaacuacuguaacauugcauuucaagcaauaugaaugcugcucucccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagggaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauaucagcccacugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagucauugccugaauccuaacaaugaggaagggggucauggagugaaaggcugggccuuugaugauggaaaugacguguggaugggaagaacaaucagcgagaaguuccgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguugcguuuuguggcaccucagguacauauggaacaggcucauggccugauggggcggacaucaaucucaugccuauauaa

SEQ ID NO: 45053 - RNA, 1410 nt, Artificial Sequence; identical to SEQ ID NO: 45018
  neuraminidase__InfluenzaA__ABB80751

SEQ ID NO: 45054 - RNA, 1410 nt, Artificial Sequence
  neuraminidase__InfluenzaA__ABB82186
augaauccaaaucaaaagauaauaacgauuggcucuguuucucuaacuauugccacaauaugcuuccuuaugcaaauagccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauauagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaccgaacccuauugaugaaugaguuggguguuccauuucauuugggaaccaagcaaguaugcauagcaugguccagcucaaguugucacgauggaaaagcauggcugcauguuuguguaacugggcaugaugaaaaugcaacugcuagcuucauuuacgaugggagacuuguagauaguauugguucaugguccaaaaaaauccucaggacccaggagucggaaugcguuuguaucaauggaacuuguacaguaguaaugacugaugggagugcuucaggaagagcugauaccaaaauacuauucauugaggaggggaaaaucguucauacuagcaaauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccuggauccuaacaaugaagaagggggucauggagugaaaggcugggccuuugaugauggaaaugacguguggaugggcagaacgaucagcgagaagucacgcucagguuaugaaaccuucaaggucauugaaggcugguccaaacccaacuccaaauugcagauaaauaggcaagucauaguugaaagagguaauaggucugguuauucugguauuuuuucuguugaaggcaaaagcugcaucaaucggugcuuuuauguggaguugauaaggggaaggaaaccggaaacugaagucugguggaccucaaacaguauuguuguguucuguggcaccucagguacauauggaacaggcucauggccugauggggcggacaucaaucucaugccuauauaa

SEQ ID NO: 45055 - RNA, 1413 nt, Artificial Sequence; identical to SEQ ID NO: 44900
  neuraminidase__InfluenzaA__ABB82197

SEQ ID NO: 45056 - RNA, 1413 nt, Artificial Sequence
  neuraminidase__InfluenzaA__ABB82208
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugucaugauggcaugggcugguuaacaaucggaauuucugguccagacaauggagcuguggcuguacuaaaauacaacggaauaauaacugaaaccauaaaaaguuggaaaaagcgaauauugagaacacaagagucugaauguguuugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 45057 - RNA, 1413 nt, Artificial Sequence
  neuraminidase__InfluenzaA__ABB82219
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuauugcugaaaaggacaaaacuucagugacauuggccggcaauucaucucuuuguuccaucaguggaugggcuauauacacaaaagacaacagcauaagaauuggcuccaaaggagauguuuuugucauaagagaaccuuucauaucauguucuaacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccucgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuuuguucaacauccugaguuaacaggauuggacuguauaagaccuugcuucuggguugaguuagucagaggacugccuagagaaaauacaacaaucuggacuagugggagcagcauuucuuuuuguggcguuaauagugaugcugcagacuggucuuggccagacggugcugaguugccguucaccauugacaaguag

SEQ ID NO: 45058 - RNA, 1410 nt, Artificial Sequence
  neuraminidase__InfluenzaA__ABB82230
augaauccaaaucaaaagauaauaacaauuggcucugucucucucaccauugcaacaguaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauugaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuacgaugggaggcuuguggacaguauugguucauggucucaaaauauccucaggacccaggagucggaaugcguuuguaucaaugggacuuguacaguaguaaugacugauggaagugcuucaggaagagcugauacuagaauacuauucauugaagaggggaaaauuguccauauuagcccauugucaggaagugcucagcauguagaggaguguuccuguuauccucgauauccuggcgucagauguaucugcagagacaacuggaaaggcucuaauaggcccaucguagauauaaaugugaaagauuauagcauugauucccguuaugugugcucagggcuuguuggcgacacacccagaaacaacgacagaucuagcaauagcaauugcaggaauccuaacaaugauaaagggaaucauggagugaaaggcugggccuuugacgauggaaaugacguguggaugggaagaacgaucagcaaggauucacgcucagguuaugaaaccuucaaagucauuggugguugguccacaccuaauuccaaaucgcagauaaauaggcaagucauaguugacagcgauaauaggucagguuauucugguauuuucucuguugagggcaaaagcugcaucaauaggugcuuuuacguggaguugauaaggggaagggaacaggagacuagaguaugguggaccucaaacaguauuguuguguuuuguggcacuucagguaccuaugggacaggcucauggccugauggggcggacaucaaucucaugccuauauaa

SEQ ID NO: 45059 - RNA, 1410 nt, Artificial Sequence
  neuraminidase__InfluenzaA__ABB83018
augaauccaaaucaaaaaauaauaacgauuggcucuguuucucucaccauugccacaauaugcuuccuuacgcaaauugccauccugguaacuacuguaacauugcauuucaagcaauauggaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacuggauuugcaccuuuuucuaaggacaauucgauucggcuuuccgcugguggggacaucuggguuacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgaugggaaagcauggcugcauguuuguguaacgggggaugauaaaaaugcaacugcuagcuucauuuacaaugggaggcuuguagauaguauagguucaugguccaaaaaaauccucaggacccaggagucggaaugcguuuguaucaauggaacuuguacaguaguaaugacugaugggagugcuucaggaaaagcugauacuaaaauacuauucauugaggaggggaaaauuguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaagggugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggagcugauaaggggaaggaaccaggaaacugaagucuuguggaccucaaacaguauuguuguguuuuguggcaccucagguacauauggaacaggcucauggccugauggggcggacaucaaucucaugccuauauaa

SEQ ID NO: 45060 - RNA, 1410 nt, Artificial Sequence
  neuraminidase__InfluenzaA__ABB83029
augaauccaaaucaaaaaauaauaacgauuggcucuguuucucucaccauugccacaauaugcuuccuuacgcaaauugccauccugguaacuacuguaacauugcauuucaagcaauauggaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacuggauuugcaccuuuuucuaaggacaauucgauucggcuuuccgcugguggggacaucuggguuacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugauaaaaaugcaacugcuagcuucauuuacaaugggaggcuuguagauaguauagguucaugguccaaaaaaauccucaggacccaggagucggaaugcguuuguaucaauggaacuuguacaguaguaaugacugaugggagugcuucaggaaaagcugauacuaaaauacuauucauugaggaggggaaaauuguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaagggugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggagcugauaaggggaaggaaccaggaaacugaagucuuguggaccucaaacaguauuguuguguuuuguggcaccucagguacauauggaacaggcucauggccugauggggcggacaucaaucucaugccuauauaa

SEQ ID NO: 45061 - RNA, 1410 nt, Artificial Sequence
  neuraminidase__InfluenzaA__ABB83130
augaauccaaaucaaaaaauaauaacgauuggcucuguuucucucaccauugccacaauaugcuuccuuacgcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugcaacauuacuggauuugcaccuuuuucuaaggacaauucgauucggcuuuccgcugguggggacaucuggguuacaagagaaccuuaugugucaugcgauccugacaaguguuaucaauuugcccuuggacagggaacaacacuaaacaacgggcauucaaaugacacaguacaugauaggaccccuuauaggacccuauugaugaaugaguuggguguuccauuucauuugggaaccaagcaagugugcauagcaugguccagcucaaguugucacgauggaaaagcauggcugcauguuuguguaacgggggaugauaaaaaugcaacugcuagcuucauuuacaaugggaggcuuguagauaguauagguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagauaauagguccgguuauucugguauuuucucuguugaaggcaaaagcugcaucaaucggugcuuuuauguggaguuaauaaggggaaggaaccaggaaacugaagucuuguggaccucaaacaguauuguuguguuuuguggcaccucagguacauauggaacaggcucauggccugauggggcggacaucaaucucaugccuauauaa

SEQ ID NO: 45062 - RNA, 1410 nt, Artificial Sequence
  neuraminidase__InfluenzaA__ABB83141
augaauccaaaucaaaaaauaauaacgauuggcucuguuucucucaccauugccacaauaugcuuccuuucgcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugcaacauuacuggauuugcaccuuuuucuaaggacaauucgauucggcuuuccgcugguggggacaucuggguuacaagagaaccuuaugugucaugcgauccugacaaguguuaucaauuugcccuuggacagggaacaacacuaaacaacgggcauucaaaugacacaguacaugauaggaccccuuauaggacccuauugaugaaugaguuggguguuccauuucauuugggaaccaagcaagugugcauagcaugguccagcucaaguugucacgauggaaaagcauggcugcauguuuguguaacgggggaugauaaaaaugcaacugcuagcuucauuuacaaugggaggcuuguagauaguauagguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagauaauagguccgguuauucugguauuuucucuguugaaggcaaaagcugcaucaaucggugcuuuuauguggaguugauaaggggaaggaaccaggaaacugaagucuuguggaccucaaacaguauuguuguguuuuguggcaccucagguacauauggaacaggcucauggccugauggggcggacaucaaucucaugccuauauaa

SEQ ID NO: 45063 - RNA, 1410 nt, Artificial Sequence
  neuraminidase__InfluenzaA__ABB86876
augaauacaaaucaaagaauaauaaccauugggacaguuugucugauaguuggaauaauuagucuauuguugcagauaggaaacauagucucguuauggauuagccacucaauucaaaccggaggaaaaaaucacucugaaaugugcaaccaaaaugucauuacauauguaaauaacacaugggugaaccgaacuuauguaaacauuagcaauaccaauauugcuacuguacaggaugugacuucaguaauauuagccggcaauucaucucuuugcucaguaagugggugggcuauauacagcaaagacaauagcauaaggauugguucuaaaggggacauuuuugucauaagagaaccauucauuucaugcucucacuuggaaugcagaacuuuuuuucugacccaaggcgcuuugcugaaugacaagcauucuaauggaaccgucaaggacaggagucccuauagaaccuuaaugaguugccccaucggugaagcuccauccccguauaacucaagguuugaaucaguugcuuggucagcaagugcaugccaugaugggaugggaugguuaacaaucggaaucuccgguccagauaauggagcaguagcuguuuuaaaauacaacgguauaauaacagauacaauaaaaaguuggagaaacaaaauauuaagaacacaagagucagaauguguuuguaugaacgguucauguuuuacuguauuaacugauggcccaagcaaugggcaagccucguacaaaauauucaaaguggaaaaagggaaaauaauuaagucaauugagcuggaugcaccuaauuaccacuaugaggaaugcuccuguuauccugauacaggcaaaguaauguguguuugcagagacaauuggcaugccucgaaccgaccaugggucucuuucgaucagaaccuugacuaucagauaggguacauaugcagugggguuuucggugauaacccgcguucuaaugaugggaagggcaauuguggcccaguacuuucuaauggagcaaauggagugaaaggauucucauuuagauauggcaaugguguuuggauaggaagaacuaaaaguauaaacuccagaagcggguuugagaugauuugggauccaaauggguggacugggacugauaguagcuucucuaugaagcaggauauuauagcauuaacugauuggucaggauauaguggaaguuuuguccaacauccugaauuaacaggaaugaauugcauaaggccuuguuucuggguagaauuaaucagagggcaacccaaggaaagcacaaucugggcuagcggaagcagcaucucuuucuguggcguagacagugaaaccacaagcuggucauggccagacggagcugaucugccauucaccauugacaaguag

SEQ ID NO: 45064 - RNA, 1410 nt, Artificial Sequence
  neuraminidase__InfluenzaA__ABB86886
augaauacaaaucaaagaauaaucaccauugggacagccuguuuggcaauuggaauaguuaguuuguuauuacagauaggaaauauagucucguuguggauaagccauucaauucaaacugaagaaaaaaaccacucugaaacaugcagccaaaauuucauuacacaugaaaacaacacaugggugaaccaaacuuauauaaacauuaguaauaccaacaauguugucggacagggcgugacuucaauaaugcuagccggcaauuccucucuuugcccaauaagugguugggcuauauacagcaaagacaacagcauaaggauugguuccaaaggagacauuuuugucauaagggaaccauucauuucaugcucucacuuggagugcagaacauuuuuucugacccaaggugcuuugcugaaugacaagcauucuaaugguaccgucaaagacaggagccccuauagaaccuuaaugagcugccccaucggugaagcuccaucuccauacaauucaagguuugaaucaguugcuuggucagcaagugcaugccacgauggaaugggauggcuaacaaucgggauuuccgguccagauaauggggcaguggcuguuuuuaaauacaaugguauaauaacagauacaauaaaaaguuggagaaacaaaauauuaagaacacaagagucagaauguguuuguauaaacgguucauguuuuaccauaaugaccgauggcccaagcaacgggcaggccucguacaaaauauucaaaauggagaaagggaagauuauuaagucaguugagcuggaugcaccuaauuaccacuaugaggaauccuccuguuacccugauacaggcaaaguggugugugugugcagagacaauuggcaugcuucgaaucgaccaugggucucuuucgaucagaaucuugauuaucagauaggguacauaugcagugggguuuucggugauaacccgcguucuaaugaugggaaaggcaauuguggcccaguacuuucuaauggagcaaauggagugaaggaggucucauuuagauauggcaaugguguuuggauaggaagaacuaaaaguaucagcucuagaaguggauuugagaugauuugggauccaaauggauggacggaaacugauaguaguuucucuauaaagcaggauauuauagcauuaacugauuggucaggauacaguggaaguuuuguccaacaucccgaauuaacaggaaugaacugcauaaagccuuguuucuggguagaguuaaucagaggacaacccaaggagagcacaaucuggacuaguggaagcagcauuucuuucuguggcguggacagugaaaccgcaagcuggucauggccagacggagcugaucugccauucaccauugacaaguag

SEQ ID NO: 45065 - RNA, 1410 nt, Artificial Sequence
  neuraminidase__InfluenzaA__ABB86898
augaauccaaaucaaaagauaauaacaauuggcucuguuucucucacccuugccacaauaugcuuccuuaugcaaauugccauccugguaacuacuguaacauugcauuucaagcagcaggaaugcaacucccccccaaacaaccaaguaaugcugugugaaccaacaauaauagaaagaaacauaacagagauaguguaucugaccaacaccacuauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaauaacacaguacaugauaggaccccuuaccggacccuauugaugaaugaauuggguguuccauuucauuugggaaccaggcaagugugcauagcaugguccagcucaaguugucacgauggaaaagcauggcugcauguuuguauaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaauuguucauauuagcacauugucaggaagugcucagcaugucgaggagugcuccuguuauccucgauauccuggugucagaugugucugcagagacaacuggaaaggauccaacaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggacgaacgaucagcgagaaguuacgcucagguuaugaaaccuucaaagucaucgaaggaugguccaaaccuaacuccaaauuacagauaaauaggcaaguuauaguugaaagagguagcagguccgguuauucugguauuuucuccguugaaggcaaaagcugcaucaaucggugcuuuuauguggaguugauaaggggaaggaaagaggaaacuaaagucugguggaccucaaacaguauuguuguguuuuguggcaccucagguacauauggaacaggcucauggccugauggggcggauaucaaucucaugccuauauaa

SEQ ID NO: 45066 - RNA, 1410 nt, Artificial Sequence
  neuraminidase__InfluenzaA__ABB86906
augaauacaaaucaaagaauaauaaccauugggacaguuugucugauaguuggaauaauuagucuauuguugcagauaggaaacauagucucguuauggauuagccacucaauucaaaccggaggaaaaaaucacucugaaaugugcaaccaaaaugucauuacauauguaaauaacacaugggugaaccgaacuuauguaaacauuagcaauaccaauauugcuacuguacaggaugugacuucaguaauauuagccggcaauucaucucuuugcucaguaagugggugggcuauauacagcaaagacaauagcauaaggauugguucuaaaggggacauuuuugucauaagagaaccauucauuucaugcucucacuuggaaugcagaacuuuuuuucugacccaaggcgcuuugcugaaugacaagcacucuaauggaaccgucaaggacaggagucccuauagaaccuuaaugaguugccccaucggugaagcuccaucuccguauaacucaagauucgaaucaguugcuuggucagcaagugcaugccaugaugggaugggaugguuaacaaucgggaucuccgguccggauaauggagcaguagcuguuuuaaaauacaacgguauaauaacagauacaauaaaaaguuggagaaacaaaauauugagaacacaagagucagaauguguuuguaugaacgguucauguuuuacuguauuaacugauggcccaagcaaugggcaagccucguacgaaauauucaaaguggaaaaggggaaaauaauuaagucgauugagcuggaugcaccuaauuaccauuaugaggaaugcucuuguuauccugauacaggcaaaguaaugugugugugcagagacaauuggcaugccucgaaccgaccauggguuucuuucgaucagaaucuuaacuaucagauaggguacauaugcagugggguuuucggugauaacccgcguucuaaugaugggaagggcaauuguggcccaguacuuucuaauggagcaaauggagugaaaggauucucauuuagauaugguaaugguguuuggauaggaagaacuaaaaguaucagcuccagaaguggguuugagaugguuugggauccaaauggguggacugggacugauaguagguuuucuaugaagcaggauauuauagcauuaacugauuggucaggauacaguggaaguuuuguccaacauccugaauuaacaggaaugaauugcauaaggccuuguuucuggguagaauuaaucagagggcaacccaaggaaagcacaaucugggcuagcggaaguagcaucucuuucugcggcguaaauagugaaaccgcaagcuggucauggccagacggagcugaucugccauucacuauugacaaguag

SEQ ID NO: 45067 - RNA, 1410 nt, Artificial Sequence
  neuraminidase__InfluenzaA__ABB86916
augaauccaaaucaaaagauaauaacgauuggcucuguuucucucaccauugccacaauaugcuuccuuacgcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugcaacauuacuggauuugcaccuuuuucuaaggacaauucgauucggcuuuccgcugguggggacaucuggguuacaagagaaccuuaugugucaugcgauccugacaaguguuaucaauuugcccuuggacagggaacaacacuaaacaacgggcauucaaaugacacaguacaugauaggaccccuuacaggacccuauugaugaaugagcuggguguuccauuucauuugggaaccaagcaagugugcauagcaugguccagcucaaguugucacgauggaaaagcauggcugcauguuuguauaacgggggaugauaaaaaugcaacugcuagcuucauuuacaaugggaggcuuguagauaguauaaguucgugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucggggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggggugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagauaauagguccgguuauucugguauuuucucuguugaaggcaaaagcugcaucaaucggugcuuuuauguggaguugauaaggggaaggaaccaggaaacugaagucuuguggaccucaaacaguauuguuguguuuuguggcaccucagguacauauggaacaggcucauggccugauggggcggacaucaaucucaugccuauauaa

SEQ ID NO: 45068 - RNA, 1410 nt, Artificial Sequence
  neuraminidase__InfluenzaA__ABB86928
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaccugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguauaacuggggaugauaaaaaugcaacugcuagcuucauuuacaaugggaggcuuguagauaguauugguucaugguccaaaaagauacucagaacccaggagucggaaugcguuuguaucaauggaacuuguacaguaguaaugacugaugggagcgcuucaggaaaagcugauacuaaaauacuauucauugaggaggggaaaauuguucauauuagcacauugucaggaagugcucagcaugucgaggagugcuccuguuauccucgauauccuggugucagaugugucugcagagacaacuggaaaggauccaacaggcccauuguagauauaaauguaaaggauuauagcauuguuuccaguuaugugugcucaggacuuguuggagacacacccagaaaaaacgacagcuucagcaguagccauugccuaaauccuaacaaugaggaagguggucauggagugaaaggcugggccuuugaugauggaaaugacguguggaugggacgaacgaucagcgagaaguuacgcucagguuaugaaaccuucaaagucaucgaaggaugguccaaaccuaacuccaaauuacagauaaauaggcaaguuauaguugaaagagguaacagguccgguuauucugguauuuucuccauugaaggcaaaagcugcaucaaucggugcuuuuauguggaguugauaaggggaaggaaagaggaaacuaaagucugguggaccucaaacaguauuguuguguuuuguggcacuucagguacauauggaacaggcucauggccugauggggcggauaucaaucucaugccuauauaa

SEQ ID NO: 45069 - RNA, 1410 nt, Artificial Sequence
  neuraminidase__InfluenzaA__ABB86936
augaauacaaaucaaagaauaauaaccauugggacgguuugccugauaguuggaauaauuagucuauuguugcagauaggaaacauagucucguuauggauuaaccacucaauucagaccgaaggaaaaaaucacucugagaugugcaaccaaaaugucauuacauauguaaauaauacaugggugaaccgaacuuauguaaacauuagcaacaccaauauugcuacuguacaggaugugacuucaguaauauuagcaggcaauuccucucuuugcccagugagugggugggcuauauacagcaaagacaauagcauaaggauuggcucuaaaggggacauuuuugucauaagagaaccauucauuucaugcucucacuuggagugcagaacuuuuuuucugacccaaggcgcuuugcugaaugacaagcauucuaauggaaccgucagggacaggagucccuauagaacuuuaaugagcugccccacuggugaagcuccaucuccguauaacucaagguucgaaucaguugcuuggucagcaagugcaugccaugaugggaugggaugguuaacaaucgggaucuccgguccagauaauggagcaguagcuguuuuaaaauacaaugguauaauaacagauacaauaaaaaguuggagaaacaaaauauuaagaacacaagagucagaauguguuuguaugaacgguucauguuuuacuguauuaacugauggcccaagcaaugggcaagccucguacaaaauauuuaaaguggaaaaagggaaaauaauuaagucaauugagcuggaugcacccaauuaccacuaugaggaaugcuccuguuauccugauacaggcaaaguaauguguguuugcagagacaauuggcaugccucgaaccgaccguggaucuauuuugaucagaaucuugacuaucagauaggguacauaugcagugggguuuucggugauaacccccguucuaaugaugggaagggcaauuguggcccaguacuuucuaauggagcaaauggagugaaaggauucucauuuagauaugguaaugguguuuggauaggaagaacuaaaaguaucaacuccagaaguggguuugagaugauuugggacccaaauggauggacuggaacugauaguaguuucucuaugaagcaggauauucuagcaacaacugauuggucaggauacaguggaaguuuuguccaacauccugaauuaacaggaaugaauugcauaaggccuuguuucuggguagaauuaaucagagggcaacccaaggaaagcacaaucugggcuagcggaagcagcaucucuuucuguggcguaaauagugaaaccgcaaacuggucauggccagacggagcugaucugccauucaccauugacaaguag

SEQ ID NO: 45070 - RNA, 1410 nt, Artificial Sequence
  neuraminidase__InfluenzaA__ABB86947
augaauacaaaucaaagaauaauaaccauugggacaguuugucugauaguuggaauaauuagucuauugucgcagauaggaaacauagucucuuuauggauuauccauucaauucagaccggagggaaaaaucacucugaaaugugcaaccaaaaugucauuacauauguaaauaauacaugggugaaccgaacuuauauaaacauuagcaauaccaacauugcuacuguaaaggaugugacuucaguaauauuagcaggcaauuccucucuuugcccaguaagugggugggcuauauacagcaaagacaauagcauaaggauugguucuaaaggggacauuuuugucauaagagaaccauucauuucaugcucucacuuggaaugcagaacuuuuuuucugacccaaggcgcuuugcugaaugacaagcauuccaauggaaccgucaaggacaggagucccuauagaaccuuaaugagcugccccaucggugaggcuccaucuccauauaacucaagguucgaaucaguugcuuggucagcaagugcaugccaugaugggaugggauggcuaacaaucgggaucuccgguccagauaauggagcaguagcuguuuuaaaauacaacgguauaauaacagauacaauaaaaaguuggagaaacaaaauacuaagaacacaagagucagaauguguuuguaugaacgguucauguuuuacuguguuaacugauggcccaagcaaugggcaagccucguacaaaauauucaaaguggaaaaaggaaaaauaauuaagucaauugagcuggaugcaccuaauuaccacuaugaggaaugcuccuguuauccugacgcaggcaaaguaauguguguuugcagagacaauuggcaugccucgaaccgaccaugggucucuuucgaccagaaucuugacuaucagaugggguacauaugcagugggguuuucggugauaacccgcguucuaaugaugggaagggcaauuguggcccaguacuuucuaauggagcaaauggagugaaaggauucucauuuagauaugguaaugguguuuggauaggaagaacuaaaaguaucaacuccagaaguggguuugagaugauuugggauccaaauggauggacuggaacugauaguaguuucucuaugaagcaggauauuauagcauuaacugauuggucaggauacaguggaaguuuuguccaacauccugaauuaacaggaaugaauugcauaaggccuuguuucuggguagaguuaaucagagggcaacccaaggaaagcacaauaugggcuagcggaagcagcaucuccuucuguggcguaaauagugaaaccgcaagcuggucauggccagauggagcugaucugccauucaccauugacaaguag

SEQ ID NO: 45071 - RNA, 1410 nt, Artificial Sequence
  neuraminidase__InfluenzaA__ABB86957
augaauacaaaucaaagaauaauaaccgucggaacagucugucugauaguuggaauaguuagucuauuauugcagauaggaaauauagucucguuauggauaagccauucaauucaaacuggagaaaaaaaccacucugagguaugcaaccaaaauaucauuacauaugaaaacaaaacaugggugaaccaaacuuauguaaacauuagcaauaccaacauugcugagggacagggcgugacuucaauaauaauggccggcaauuccucucuuugcccaguaagugggugggcuauauacagcaaagacaauagcauaaggauugguuccaaaggagacauuuuugucauaagagaaccauucauuucaugcucucacuuggagugcagaaccuuuuuucugacccaaggugcuuugcuaaaugacaggcauucuaauggaaccguuaaggacaggagcccuuaccgaaccuuaaugagcugcccgaucggugaagcuccauccccauauaauucaagauucgaaucaguugcuuggucagcaagugcaugccaugauggaaugggauggcuaacaaucgggauuuccgguucagauaaugaagcaguggcuguuuugaaguacaaugguauaauaacagauacaauaaaaaguuggagaaacaagauacuaagaacacaagagucagaauguguuuguauaaacgguucguguuuuacuauaaugacugauggcccaagcaaugggcaagccucguacaaaauauucaaaauggagaaagggaagauuauuaagucaguugagcuggaagcaccuaauuaccacuaugaggaaugcuccuguuacccugauacaggcaaaguggugugugugugcagagacaauuggcaugcuucaaaucgaccgugggucucuuucaaucagaaucuugauuaucagauaggguacauaugcagugggguuuucggugauaacccgcguucuaaugaugggaaagguaauuguggcccaguaccuucuaauggagcaaauggagugaagggauucucauuuagauaugguaaugguguuuggauaggaaggacuaaaaguaucuucucuagaaguggauuugagaugauuugggacccaaauggauggacggaaacugauaguaguuucucuauaaagcaggauauuauagcauuaacugauuggucaggauacaguggaaguuuuguccaacauccugaauuaacaggaaugaacugcauaaggccuuguuuuuggguagaguuaaucagaggacaacccaaagagaguacaaucuggacuagugggagcagcauuucuuucugugguguggacagugaaacugcaagcuggucauggccagacggggcugaucugccauucaccauugacaaguag

SEQ ID NO: 45072 - RNA, 1410 nt, Artificial Sequence
  neuraminidase__InfluenzaA__ABB96333
augaauccaaaucaaaagauaauaacaauuggcucugucucucucaccauugcaacaauaugcuuccucaugcaaauugccauccugguaacuacuguaacauugcauuucaagcaauaugauugcgacucccccgcaaacaaccaaguaaugccgugugaaccaauaauaauagaaaggaacauaacagagauaguguauuugacuaacaccaccauagagaaagagauaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaagcauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggauaugauaaaaaugcaacugcuagcuucauuuacgaugggaggcuuguagacaguauugguucauggucuaaaaauauccucaggacccaggagucggaaugcguuuguaucaaugggacuuguacaguaguaaugacugauggaagugcuucagaaagagcugauacuaaaauacuauucauugaagaggggaaaauuguucauauuagcccauugucaggaagugcucagcauguagaggaguguuccuguuauccucgauauccuggugucagaugugucugcagagacaacuggaaaggcucuaauaggcccgucguagauauaaaugugaaagauuauagcauugcuuccaguuaugugugcucagggcuuguuggcgacacacccagaaaaaacgacagauauagcaguagcuauugccggaauccuaacaaugagaaagggaaucauggagugaaaggcugggccuuugacgauggaaaugacguguggaugggaagaacgaucagcgaugagucacgcucagguuaugaaacuuucaaagucauuggugguugguccacaccuaauuccaaauugcagauaaauaggcaagucauaguugacagcgauaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcacuucagguaccuaugggacaggcucauggccugauggagcggacaucaaucucaugccuauauaa

SEQ ID NO: 45073 - RNA, 1410 nt, Artificial Sequence
  neuraminidase__InfluenzaA__ABB96344
augaauccaaaucaaaagauaauaacaauuggcucugucucucucaccauugcaacaauaugcuuccucaugcaaauugccauccugguaacuacuguaacauugcauuucaagcaauaugagugcgacucccccgcaaacaaccaaguaaugccgugugaaccaauaauaauagaaaggaacauaacagagauaguguauuugacuaacaccaccauagagaaagagauaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcagguguuaucaauuugcacucgggcaggggaccacacuagacaacaagcauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggauaugauaaaaaugcaacugcuagcuucauuuacgaugggaggcuuguagacaguauugguucauggucuaaaaauauccucaggacccaggagucggaaugcguuuguaucaaugggacuuguacaguaguaaugacugauggaagugcuucagaaagagcugauacuaaaguacuauucauugaagaggggaaaauuguucauauuagcccauugucaggaagugcucagcauguagaggaguguuccuguuauccucgauauccuggugucagaugugucugcagagacaacuggaaaggcucuaauaggcccgucguagauauaaaugugaaagauuauagcauugcuuccaguuaugugugcucagggcuuguuggcgacacacccagaaaaaacgacagauauagcaguagcuauugccggaauccuaacaaugagaaagggaaucauggagugaaaggcugggccuuugacgauggaaaugacguguggaugggaagaacgaucagcgaugagucacgcucagguuaugaaacuuucaaagucauuggugguugguccacaccuaauuccaaauugcagauaaauaggcaagucauaguugacagcgauaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcacuucagguaccuaugggacaggcucauggccugauggagcggacaucaaucucaugccuauauaa

SEQ ID NO: 45074 - RNA, 1410 nt, Artificial Sequence
  neuraminidase__InfluenzaA__ABB96398
augaauccaaaucaaaagauaauaacaauuggcucugucucucucaccauugcaacaauaugcuuccucaugcaaauugccauccugguaacuacuguaacauugcauuucaagcaauaugagugcgacucccccgcaaacaaccaaguaaugccgugugaaccaauaauaauagaaaggaacauaacagagauaguguauuugacuaacaccaccauagagaaagagacaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaagcauucaaaugacacaauacaugauagaaccccuuaucgaacccuauugaugaaugaguuggguguuccauuucauuugggaaccaggcaaguguguauagcaugguccagcucaaguugucacgauggaaaagcauggcugcauguuugugucacuggauaugauaaaaaugcaacugcuagcuucauuuacgaugggaggcuuguagacaguauugguucauggucuaaaaauauccucaggacccaggagucggaaugcguuuguaucaaugggacuuguacaguaguaaugacugauggaagugcuucagaaagagcugauacuaaaauacuauucauugaagaggggaaaauuguucauauuagcccauugucaggaagugcucagcauguagaggaguguuccuguuauccucgauauccuggugucagaugugucugcagagacaacuggaaaggcucuaauaggcccgucguagauauaaaugugaaagauuauagcauugcuuccaguuaugugugcucagggcuuguuggcgacacacccagaaaaaacgacagaucuagcaguagcuauugccggaauccuaacaaugagaaagggaaucauggagugaaaggcugggccuuugacgauggaaaugacguguggaugggaagaacgaucagcgaggagucacgcucagguuaugaaaccuucaaagucauuggugguugguccacaccuaauuccaaauugcagauaaauaggcaagucauaguugacagcgauaauagguccgguuacucugguauuuucucuguugagggcaaaagcugcaucaauaggugcuuuuauguggaguugauaaggggaagggaacaggaaacuagagucugguggaccucaaacaguauuguuguguuuuguggcacuucagguaccuaugggacaggcucauggccugauggagcggacaucaaucucaugccuauauaa

SEQ ID NO: 45075 - RNA, 1410 nt, Artificial Sequence; identical to SEQ ID NO: 44886
  neuraminidase__InfluenzaA__ABB96490

SEQ ID NO: 45076 - RNA, 1410 nt, Artificial Sequence
  neuraminidase__InfluenzaA__ABB96501
augaauccaaaucaaaagauaauaacaauuggcucugucucucucaccauugcaacaauaugcuuccuuaugcaaauugccauccugguaacuacuguaacauugcauuucaagcaauaugagugcagcucccccccaaacaaccaaguaaugccgugugaaccaauaauaauagaaaggaacauaacagagauaguguauuugacuaacaccaccauagagaaagagauaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugugauccuagcaaguguuaucaauuugcacucgggcaggggaccacacuagacaacaagcauucaaaugacacaauacaugauaggaccccucaucgaacccuauugaugaaugaguuggguguuccauuucauuugggaaccaggcaaguguguauagcaugguccagcucaaguugucacgaugggaaagcauggcugcauguuugugucacuggguaugauaaaaaugcaacugcuagcuucauuuacgaugggaggcuuguagacaguauugguucaugguccaaaaauauccucaggacccaggaaucggaaugcguuuguaucaaugggacuuguacaguaguaaugacugauggaagugcuucagaaagagcugauacuaaaauacuguucauugaagaggggaaaaucguucauauuagcccauugucaggaagugcucagcauguagaggaguguuccuguuauccucgauauccuggugucagaugugucugcagagacaacuggaaaggcuccaauaggcccgucguagacauaaaugugaaagauuauagcauuguuuccaguuaugugugcucagggcuuguuggcgacacacccagaaaaaacgacagaucuagcaguagcuauugccggaauccuaacaaugagaaagggaaucauggagugaaaggcugggccuuugacgauggaaaugacguguggaugggaagaacgaucagcgaggagucacgcucagguuaugaaaccuucaaagucauuggugguugguccacaccuaauuccaaaucgcagauaaauaggcaagucauaguugacagcgguaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcacuucagguaccuauggaacaggcucauggccugauggagcggacaucaaucucaugccuauauaa

SEQ ID NO: 45077 - RNA, 1410 nt, Artificial Sequence
  neuraminidase__InfluenzaA__ABB96534
augaauccaaaucaaaagauaauaacgauuggcucuguuucucucacuauugccacaauaugcuuccuuaugcaaauugccauccugguaacuacuguaacauugcauuucaagcaauaugaaugcagcucucccccaaacaaccaaguaaugcugugugaaccaacaauaauagaaagaaacauaacagagauaguguaucugaccaacaccaccauagagaaggaaauaugccccaaacuagcagaauacagaaauuggucaaaaccgcaauguaaaauuacaggauuugcaccuuuuucuaaggacaauucaauucggcuuuccgcugguggggacauuugggugacaagggaaccuuaugugucgugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauaucagcccacugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagucauugccugaauccuaacaaugaggaagggggucauggagugaaaggcugggccuuugaugauggaaaugacguguggaugggaagaacgaucagcgagaaguuccgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45078 - RNA, 1410 nt, Artificial Sequence
  neuraminidase__InfluenzaA__ABC02237
augaauccaaaucaaaagauaauaacgauuggcucuguuucucucacuauugccacaauaugcuuccuuaugcaaauugccauccugguaacuacuguaacauugcauuucaagcaauaugaaugcagcucucccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagggaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauuuauugaggaggggaaaaucguucauaucagccaacuaucaggaagugcucagcaugucgaggagugcuccuguuauccucgauauccuggugucagaugugucugcagagacaacuggaaaggcuccaauaggcccaucguagauauaaauauaaaggauuauagcauuguuuccaguuaugugugcucaggacuuguuggagacacacccagaaaaaacgacagcuccagcaguagucauugccugaauccuaacaaugaggaagggggucauggagugaaaggcugggccuuugaugauggaaaugacguguggaugggaagaacaaucagcgagaaguuccgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguugcguuuuguggcaccucagguacauauggaacaggcucauggccugauggggcggacaucaaucucaugccuauauaa

SEQ ID NO: 45079 - RNA, 1410 nt, Artificial Sequence
  neuraminidase__InfluenzaA__ABC02258
augaauccaaaucaaaagauaauaacaauuggcucugucucucucaccauugcaacaauaugcuuccucaugcagauugccauccugguaacuacuguaacauugcauuucaagcaguaugagugcgacucccccgcgaacaaucaaauaaugccgugugaaccaacaauaauagaaaggaacauaacagagauaguguauuugacuaacaucaccauagaaaaagagauaugccccaaauuaguggaauacaggaauuggucaaagccgcaauguaaaauuacaggauuugcaccuuuuucuaaggacaauucaauucggcuuucugcugguggggacauuugggugacgagagaaccuuaugugucaugcgauccuagcaaguguuaucaauuugcacuugggcaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauccucaggacccaggagucggaaugcguuuguaucaaugggacuuguacaguaguaaugacugauggaagugcuucaggaagagcugauacuaaaauacuauucauugaagaggggaaaauuguucauauuagcccauugucaggaagugcucagcauguagaggaguguuccuguuacccucgauauccuggugucagauguaucugcagagacaacuggaaaggcucuaauaggcccgucguagauauaaaugugaaagauuauagcauugauuccaguuaugugugcucagggcuuguuggcgacacacccagaaaaaacgacagaucuagcaauagcuauugccggaauccuaacaaugagaaagggaaucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuauggggcaggcucauggccugauggggcggacaucaaucucaugccuauauaa

SEQ ID NO: 45080 - RNA, 1410 nt, Artificial Sequence
  neuraminidase__InfluenzaA__ABC02269
augaauccaaaucaaaagauaauaacaauuggcucugucucucucaccauugcaacaauaugcuuccucaugcagauugccauccugguaaccacuguaacauugcauuucaagcaauaugagugcgacuccccagcgaacaaccaaguaaugccgugugaaccaauaauaauagaaaggaacauaacagagauaguguauuugacuaacaccaccauagaaaaagagauaugccccaaauuaguggaauacaggaauuggucaaagccacaauguaaaauuacaggauuugcaccuuucucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucacuugggaaccaggcaaguguguauagcaugguccagcucaaguugucacgauggaaaagcauggcugcauguuugugucacuggguaugauaaaaaugcaacugcuagcuucauuuacgaugggaggcuuguagacagcauugguucauggucucaaaauauccucaggacccaggagucggaauguguuuguaucaaugggacuuguacaguaguaaugacugauggaagugcuucaggaagagcugauacuaaaauacuauucauugaagaggggaaaauuguucauacuagcccauugucaggaagugcucagcauguagaggaguguuccuguuauccucgauauccuggugucagauguaucugcagagacaacuggaaaggcucuaauaggccagucguagauauaaaugugaaagauuauagcauugauuccaguuaugugugcucagggcuugugggcgacacacccagaaacaacgacagaucuagcaguagcuauugccggaauccuaacaaugaaaaagggacucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 45081 - RNA, 1413 nt, Artificial Sequence
  neuraminidase__InfluenzaA__ABC02280
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaagguucucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45082 - RNA, 1410 nt, Artificial Sequence
  neuraminidase__InfluenzaA__ABC02302
augaauccaaaucaaaagauaauaacgauuggcucuguuucucucacuauugccacaauaugcuuccuuaugcaaauugccauccugguaacuacuguaacauugcauuucaagcaauaugaaugcagcucucccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagggaaccuuaugugucgugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugagaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauaucagcccacugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagucauugccugaauccuaacaaugaggaagggggucauggagugaaaggcugggccuuugaugauggaaaugacguguggaugggaagaacgaucagcgagaaguuccgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45083 - RNA, 1410 nt, Artificial Sequence; identical to SEQ ID NO: 45074
  neuraminidase__InfluenzaA__ABC02313

SEQ ID NO: 45084 - RNA, 1410 nt, Artificial Sequence; identical to SEQ ID NO: 45079
  neuraminidase__InfluenzaA__ABC02324

SEQ ID NO: 45085 - RNA, 1410 nt, Artificial Sequence
  neuraminidase__InfluenzaA__ABC02335
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacaggaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacuagggcaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauccucaggacccaggagucggaaugcguuuguaucaaugggacuuguacaguaguaaugacugauggaagugcuucaggaagagcugauacuaaaauacuauucauuaaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaauagcuauugccggaauccuaacaaugagaaagggaaucacggagugaaaggcugggccuuugaugauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 45086 - RNA, 1410 nt, Artificial Sequence
  neuraminidase__InfluenzaA__ABC39808
augaauccaaaucaaaagauaauaacaauuggcucugucucucucaccauugcaacaauaugcuuccuuaugcaaauugccauccugguaacuacuguaacauugcauuucaagcaauaugagugcagcucccccccaaacaaccaaguaaugccaugugaaccaauaauaauagaaaggaacauaacagagauaguguauuugacuaacaccaccauagagaaagagauaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugugauccuagcaaguguuaucaauuugcacucgggcaggggaccacacuagacaacaagcauucaaaugacacaauacaugauaggaccccucaucgaacccuauugaugaaugaguuggguguuccauuucauuugggaaccaggcaaguguguauagcaugguccagcucaaguugucacgaugggaaagcauggcugcauguuugugucacuggguaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuguucauugaagaggggaaaaucguucauauuagcccauugucaggaagugcucagcauguagaggaguguuccuguuauccucgauauccuggugucagaugugucugcagagacaacuggaaaggcuccaauaggcccgucguagauauaaaugugaaagauuauagcauuguuuccaguuaugugugcucagggcuuguuggcgacacacccagaaaaaacgacagaucuagcaguagcuauugccggaauccuaacaaugagaaaggggaucauggagugaaaggcugggccuuugacgauggaaaugacguguggaugggaagaacgaucagcgaggagucacgcucagguuaugaaaccuucaaagucauuggugguugguccacaccuaauuccaaaucgcagauaaauaggcaagucauaguugacagcgguaauagguccgguuauucugguauuuucucuguugagggcaaaagcugcaucaauaggugcuuuuauguggaguugauaaggggaaggaaacaggaaacuagagucugguggaccucaaacaguauuguuguguuuuguggcacuucagguaccuauggaacaggcucauggccugauggagcggacaucaaucucaugccuauauaa

SEQ ID NO: 45087 - RNA, 1410 nt, Artificial Sequence; identical to SEQ ID NO: 44886
  neuraminidase__InfluenzaA__ABC40525

SEQ ID NO: 45088 - RNA, 1413 nt, Artificial Sequence
  neuraminidase__InfluenzaA__ABC40536
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacaguaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuauuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45089 - RNA, 1410 nt, Artificial Sequence; identical to SEQ ID NO: 45080
  neuraminidase__InfluenzaA__ABC40547

SEQ ID NO: 45090 - RNA, 1410 nt, Artificial Sequence
  neuraminidase__InfluenzaA__ABC40558
augaauccaaaucaaaagauaauaacaauuggcucugucucucucaccauugcaacaauaugcuuccuuaugcaaauugccauccugguaacuacuguaacauugcauuucaagcaauaugagugcagcucccccccaaacaaccaaguaaugccgugugaaccaauaauaauagaaagaaacauaacagagauaguguauuugacuaacaccaccauagagaaagagauaugccccaaacuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaagcauucaaaugacacaauacaugauaggaccccuuaucgaacccuauugaugaaugaguuggguguuccauuucauuugggaaccaggcaaguguguauagcaugguccagcucaaguugucacgauggaaaagcauggcugcauguuugugucacugggcaugauaaaaaugcaacugcuagcuucauuuacgaugggaggcuuguagacaguauugguucaugguccaaaaguauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggaguguuccuguuauccucgauauccuggugucagaugugucugcagagacaacuggaaaggcuccaauaggcccgucguagauauaaaugugaaagauuauagcauuguuuccaguuaugugugcucagggcuuguuggcgacacacccagaaaaaacgacagaucuagcaguagcuauugccagaauccuaacaaugagaaagggaaucauggagugaaaggcugggccuuugacgauggaaaugacguguggaugggaagaacgaucagugaggagucacgcucagguuaugaaaccuucaaagucauuggugguugguccacaccuaauuccaaauugcagauaaauaggcaagucauaguugacaucgauaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcacuucagguaccuauggaacaggcucauggccugauggagcggacaucaaucucaugccuauauaa

SEQ ID NO: 45091 - RNA, 1410 nt, Artificial Sequence
  neuraminidase__InfluenzaA__ABC40611
augaauccaaaucaaaagauaauaacgauuggcucuauuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcuguaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45092 - RNA, 1410 nt, Artificial Sequence
  neuraminidase__InfluenzaA__ABC40622
augaauccaaaucaaaagauaauaacaauuggcucugucucucucaccauugcaacaauaugcuuccucaugcagauugccauccugguaacuacuguaacauugcauuucaagcaguaugagugcgacucccccgcgaacaaccaaguaaugccgugugaaccaauaauaauagaaaggaacauaacagagauaguguauuugacuaacaccaccauagaaaaagagauaugccccaaauuaguggaauacaggaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauccucaggacccaggagucggaaugcguuuguaucaaugggacuuguacaguaguaaugacugauggaaaugcuucaggaagagcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaauagcuauugccggaauccuaacaaugagaaagggaaucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 45093 - RNA, 1410 nt, Artificial Sequence
  neuraminidase__InfluenzaA__ABC40634
augaauccaaaucaaaaaauaauaacgauuggcucuguuucucucaccauugccacaauaugcuuccuuacgcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacuggauuugcaccuuuuucuaaggacaauucgauucggcuuuccgcugguggggacaucuggguuacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugauaaaaaugcaacugcuagcuucauuuacaaugggaggcuuguagauaguauagguucaugguccaaaaaaauccucaggacccaggagucggaaugcguuuguaucgauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggagcugauaaggggaaggaaccaggaaacugaagucuuguggaccucaaacaguauuguuguguuuuguggcaccucagguacauauggaacaggcucauggccugauggggcggacaucaaucucaugccuauauaa

SEQ ID NO: 45094 - RNA, 1410 nt, Artificial Sequence
  neuraminidase__InfluenzaA__ABC40645
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguguuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaauuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagagguaauagguccgguuauucugguauuuucucuguugaaggcaaaagcugcaucaaucggugcuuuuauguggaguugauaagaggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 45095 - RNA, 1410 nt, Artificial Sequence
  neuraminidase__InfluenzaA__ABC41706
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45096 - RNA, 1413 nt, Artificial Sequence
  neuraminidase__InfluenzaA__ABC41717
augaauccaaaucaaaaaauaauaaccauuggaucaaucaguauagcaaucggaauaauuagucuaauguugcaaauaggaaauauuauuucaauaugggcuagucacucaauccaaacuggaagucaaaaucacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaguaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaauugccguucaccauugacaaguag

SEQ ID NO: 45097 - RNA, 1410 nt, Artificial Sequence
  neuraminidase__InfluenzaA__ABC41728
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaauauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45098 - RNA, 1410 nt, Artificial Sequence; identical to SEQ ID NO: 45095
  neuraminidase__InfluenzaA__ABC41742

SEQ ID NO: 45099 - RNA, 1410 nt, Artificial Sequence; identical to SEQ ID NO: 45095
  neuraminidase__InfluenzaA__ABC41956

SEQ ID NO: 45100 - RNA, 1410 nt, Artificial Sequence; identical to SEQ ID NO: 45095
  neuraminidase__InfluenzaA__ABC41967

SEQ ID NO: 45101 - RNA, 1410 nt, Artificial Sequence; identical to SEQ ID NO: 45095
  neuraminidase__InfluenzaA__ABC42017

SEQ ID NO: 45102 - RNA, 1410 nt, Artificial Sequence; identical to SEQ ID NO: 45095
  neuraminidase__InfluenzaA__ABC42117

SEQ ID NO: 45103 - RNA, 1410 nt, Artificial Sequence; identical to SEQ ID NO: 45095
  neuraminidase__InfluenzaA__ABC42128

SEQ ID NO: 45104 - RNA, 1410 nt, Artificial Sequence; identical to SEQ ID NO: 45095
  neuraminidase__InfluenzaA__ABC42139

SEQ ID NO: 45105 - RNA, 1410 nt, Artificial Sequence
  neuraminidase__InfluenzaA__ABC42150
augaauccaaaucaaaagauaauaacaauuggcucuguuucucucaccauugccacaauaugcuuccuuaugcaaauugccauccuggcaaccacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgggaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45106 - RNA, 1410 nt, Artificial Sequence; identical to SEQ ID NO: 45095
  neuraminidase__InfluenzaA__ABC42161

SEQ ID NO: 45107 - RNA, 1410 nt, Artificial Sequence
  neuraminidase__InfluenzaA__ABC42172
augaauccaaaucaaaagauaauaacaauuggcucuguuucucucaccauugccacaauaugcucccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45108 - RNA, 1410 nt, Artificial Sequence; identical to SEQ ID NO: 45095
  neuraminidase__InfluenzaA__ABC42183

SEQ ID NO: 45109 - RNA, 1410 nt, Artificial Sequence
  neuraminidase__InfluenzaA__ABC42195
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaacgaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45110 - RNA, 1410 nt, Artificial Sequence; identical to SEQ ID NO: 45095
  neuraminidase__InfluenzaA__ABC42310

SEQ ID NO: 45111 - RNA, 1410 nt, Artificial Sequence
  neuraminidase__InfluenzaA__ABC42321
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugagccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45112 - RNA, 1410 nt, Artificial Sequence; identical to SEQ ID NO: 45095
  neuraminidase__InfluenzaA__ABC42349

SEQ ID NO: 45113 - RNA, 1410 nt, Artificial Sequence
  neuraminidase__InfluenzaA__ABC42464
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugucuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45114 - RNA, 1410 nt, Artificial Sequence; identical to SEQ ID NO: 45095
  neuraminidase__InfluenzaA__ABC42497

SEQ ID NO: 45115 - RNA, 1410 nt, Artificial Sequence; identical to SEQ ID NO: 45095
  neuraminidase__InfluenzaA__ABC42508

SEQ ID NO: 45116 - RNA, 1410 nt, Artificial Sequence; identical to SEQ ID NO: 45095
  neuraminidase__InfluenzaA__ABC42519

SEQ ID NO: 45117 - RNA, 1410 nt, Artificial Sequence
  neuraminidase__InfluenzaA__ABC42530
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuuuauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45118 - RNA, 1410 nt, Artificial Sequence; identical to SEQ ID NO: 45095
  neuraminidase__InfluenzaA__ABC42577

SEQ ID NO: 45119 - RNA, 1410 nt, Artificial Sequence
  neuraminidase__InfluenzaA__ABC42588
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuugcacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45120 - RNA, 1410 nt, Artificial Sequence; identical to SEQ ID NO: 44870
  neuraminidase__InfluenzaA__ABC42599

SEQ ID NO: 45121 - RNA, 1410 nt, Artificial Sequence
  neuraminidase__InfluenzaA__ABC42610
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugaccgaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagauccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45122 - RNA, 1410 nt, Artificial Sequence; identical to SEQ ID NO: 44870
  neuraminidase__InfluenzaA__ABC42621

SEQ ID NO: 45123 - RNA, 1410 nt, Artificial Sequence
  neuraminidase__InfluenzaA__ABC42632
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcauguugaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45124 - RNA, 1410 nt, Artificial Sequence; identical to SEQ ID NO: 44870
  neuraminidase__InfluenzaA__ABC42643

SEQ ID NO: 45125 - RNA, 1410 nt, Artificial Sequence
  neuraminidase__InfluenzaA__ABC42654
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuugugugacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45126 - RNA, 1410 nt, Artificial Sequence; identical to SEQ ID NO: 44870
  neuraminidase__InfluenzaA__ABC42665

SEQ ID NO: 45127 - RNA, 1410 nt, Artificial Sequence; identical to SEQ ID NO: 44870
  neuraminidase__InfluenzaA__ABC42676

SEQ ID NO: 45128 - RNA, 1410 nt, Artificial Sequence; identical to SEQ ID NO: 44870
  neuraminidase__InfluenzaA__ABC42687

SEQ ID NO: 45129 - RNA, 1410 nt, Artificial Sequence; identical to SEQ ID NO: 44870
  neuraminidase__InfluenzaA__ABC42698

SEQ ID NO: 45130 - RNA, 1410 nt, Artificial Sequence; identical to SEQ ID NO: 44870
  neuraminidase__InfluenzaA__ABC42709

SEQ ID NO: 45131 - RNA, 1410 nt, Artificial Sequence
  neuraminidase__InfluenzaA__ABC42720
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcucuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45132 - RNA, 1410 nt, Artificial Sequence
  neuraminidase__InfluenzaA__ABC42742
augaauccaaaucaaaagauaauaacgauuggcucuguuucucucaccauuuccacaauaugcuucuuuaugcaaauugccaucuugaugacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaagaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45133 - RNA, 1410 nt, Artificial Sequence; identical to SEQ ID NO: 44870
  neuraminidase__InfluenzaA__ABC42764

SEQ ID NO: 45134 - RNA, 1410 nt, Artificial Sequence; identical to SEQ ID NO: 44870
  neuraminidase__InfluenzaA__ABC42775

SEQ ID NO: 45135 - RNA, 1410 nt, Artificial Sequence; identical to SEQ ID NO: 44870
  neuraminidase__InfluenzaA__ABC42786

SEQ ID NO: 45136 - RNA, 1410 nt, Artificial Sequence; identical to SEQ ID NO: 44870
  neuraminidase__InfluenzaA__ABC42797

SEQ ID NO: 45137 - RNA, 1410 nt, Artificial Sequence
  neuraminidase__InfluenzaA__ABC42808
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaguugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45138 - RNA, 1410 nt, Artificial Sequence; identical to SEQ ID NO: 44870
  neuraminidase__InfluenzaA__ABC42819

SEQ ID NO: 45139 - RNA, 1410 nt, Artificial Sequence
  neuraminidase__InfluenzaA__ABC42841
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaagaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45140 - RNA, 1410 nt, Artificial Sequence
  neuraminidase__InfluenzaA__ABC42852
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacguugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45141 - RNA, 1410 nt, Artificial Sequence; identical to SEQ ID NO: 44870
  neuraminidase__InfluenzaA__ABC42863

SEQ ID NO: 45142 - RNA, 1410 nt, Artificial Sequence; identical to SEQ ID NO: 44670
  neuraminidase__InfluenzaA__ABC42874

SEQ ID NO: 45143 - RNA, 1410 nt, Artificial Sequence; identical to SEQ ID NO: 44670
  neuraminidase__InfluenzaA__ABC42885

SEQ ID NO: 45144 - RNA, 1410 nt, Artificial Sequence; identical to SEQ ID NO: 44670
  neuraminidase__InfluenzaA__ABC42896

SEQ ID NO: 45145 - RNA, 1410 nt, Artificial Sequence; identical to SEQ ID NO: 45095
  neuraminidase__InfluenzaA__ABC42914

SEQ ID NO: 45146 - RNA, 1410 nt, Artificial Sequence
  neuraminidase__InfluenzaA__ABC42932
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45147 - RNA, 1410 nt, Artificial Sequence
  neuraminidase__InfluenzaA__ABC42943
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguaggauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45148 - RNA, 1410 nt, Artificial Sequence; identical to SEQ ID NO: 45095
  neuraminidase__InfluenzaA__ABC42954

SEQ ID NO: 45149 - RNA, 1410 nt, Artificial Sequence
  neuraminidase__InfluenzaA__ABC42965
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguucuguggcaccucagguacauauggaacaggcucauggccugauggggcggauaucaaucucaugccuauauaa

SEQ ID NO: 45150 - RNA, 1410 nt, Artificial Sequence
  neuraminidase__InfluenzaA__ABC42976
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaagcaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45151 - RNA, 1410 nt, Artificial Sequence; identical to SEQ ID NO: 45095
  neuraminidase__InfluenzaA__ABC42987

SEQ ID NO: 45152 - RNA, 1410 nt, Artificial Sequence; identical to SEQ ID NO: 45095
  neuraminidase__InfluenzaA__ABC42998

SEQ ID NO: 45153 - RNA, 1410 nt, Artificial Sequence
  neuraminidase__InfluenzaA__ABC43009
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuauguaugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45154 - RNA, 1410 nt, Artificial Sequence; identical to SEQ ID NO: 45095
  neuraminidase__InfluenzaA__ABC43020

SEQ ID NO: 45155 - RNA, 1410 nt, Artificial Sequence
  neuraminidase__InfluenzaA__ABC43042
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugucuauauaa

SEQ ID NO: 45156 - RNA, 1410 nt, Artificial Sequence
  neuraminidase__InfluenzaA__ABC43053
augaauccaaaucaaaagauaauaacaauuggcucuguuucucucaccauugccacaauaugcuuccucaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45157 - RNA, 1410 nt, Artificial Sequence
  neuraminidase__InfluenzaA__ABC43064
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagagaaaacugaagucugguggaccucaaacaguauuguuguguuuuguggcaccucagguacauauggaacaggcucauggccugauggggcggauaucaaucucaugccuauauaa

SEQ ID NO: 45158 - RNA, 1410 nt, Artificial Sequence; identical to SEQ ID NO: 45095
  neuraminidase__InfluenzaA__ABC43075

SEQ ID NO: 45159 - RNA, 1410 nt, Artificial Sequence
  neuraminidase__InfluenzaA__ABC43086
augaauccaaaucaaaagauaauaacaauuggcucuguuucucucaucauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45160 - RNA, 1410 nt, Artificial Sequence; identical to SEQ ID NO: 45095
  neuraminidase__InfluenzaA__ABC43097

SEQ ID NO: 45161 - RNA, 1410 nt, Artificial Sequence; identical to SEQ ID NO: 45095
  neuraminidase__InfluenzaA__ABC43108

SEQ ID NO: 45162 - RNA, 1410 nt, Artificial Sequence; identical to SEQ ID NO: 45153
  neuraminidase__InfluenzaA__ABC43119

SEQ ID NO: 45163 - RNA, 1410 nt, Artificial Sequence; identical to SEQ ID NO: 44870
  neuraminidase__InfluenzaA__ABC43130

SEQ ID NO: 45164 - RNA, 1410 nt, Artificial Sequence; identical to SEQ ID NO: 44870
  neuraminidase__InfluenzaA__ABC43141

SEQ ID NO: 45165 - RNA, 1410 nt, Artificial Sequence; identical to SEQ ID NO: 44870
  neuraminidase__InfluenzaA__ABC43152

SEQ ID NO: 45166 - RNA, 1410 nt, Artificial Sequence; identical to SEQ ID NO: 44870
  neuraminidase__InfluenzaA__ABC43163

SEQ ID NO: 45167 - RNA, 1410 nt, Artificial Sequence; identical to SEQ ID NO: 44870
  neuraminidase__InfluenzaA__ABC43174

SEQ ID NO: 45168 - RNA, 1410 nt, Artificial Sequence
  neuraminidase__InfluenzaA__ABC43185
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuagaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45169 - RNA, 1410 nt, Artificial Sequence; identical to SEQ ID NO: 44870
  neuraminidase__InfluenzaA__ABC43478

SEQ ID NO: 45170 - RNA, 1410 nt, Artificial Sequence; identical to SEQ ID NO: 44870
  neuraminidase__InfluenzaA__ABC43489

SEQ ID NO: 45171 - RNA, 1410 nt, Artificial Sequence
  neuraminidase__InfluenzaA__ABC43500
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacaccuagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45172 - RNA, 1410 nt, Artificial Sequence
  neuraminidase__InfluenzaA__ABC43511
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaacaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45173 - RNA, 1410 nt, Artificial Sequence
  neuraminidase__InfluenzaA__ABC43522
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugagggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45174 - RNA, 1410 nt, Artificial Sequence; identical to SEQ ID NO: 44870
  neuraminidase__InfluenzaA__ABC43533

SEQ ID NO: 45175 - RNA, 1410 nt, Artificial Sequence; identical to SEQ ID NO: 44870
  neuraminidase__InfluenzaA__ABC43544

SEQ ID NO: 45176 - RNA, 1410 nt, Artificial Sequence; identical to SEQ ID NO: 44910
  neuraminidase__InfluenzaA__ABC43555

SEQ ID NO: 45177 - RNA, 1410 nt, Artificial Sequence
  neuraminidase__InfluenzaA__ABC46557
augaauccaaaucaaaagauaauaacaauuggcucugucucucucaccauugcaacaauaugcuuccucaugcaaauugccauccugguaacuacuguaacauugcauuucaagcaauaugagugcgacucccccgcaaacaaccaaguaaugccgugugaaccaauaauaauagaaaggaacauaacagagauaguguauuugacuaacaccaccauagagaaagagacaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaagcauucaaaugacacaauacaugauagaaccccuuaucgaacccuauugaugaaugaguuggguguuccauuucauuugggaaccaggcaaguguguauagcaugguccagcucaaguugucacgauggaaaagcauggcugcauguuugugucacuggauaugauaaaaaugcaacugccagcuucauuuacgaugggaggcuuguagacaguauugguucauggucuaaaaauauccucaggacccaggagucggaaugcguuuguaucaaugggacuuguacaguaguaaugacugauggaagugcuucagaaagagcugauacuaaaauacuauucauugaagaggggaaaauuguucauauuagcccauugucaggaagugcucagcauguagaggaguguuccuguuauccucgauauccuggugucagaugugucugcagagacaacuggaaaggcucuaauaggcccgucguagauauaaaugugaaagauuauagcauugcuuccaguuaugugugcucagggcuuguuggcgacacacccagaaaaaacgacagaucuagcaguagcuauugccggaauccuaacaaugagaaagggaaucauggagugaaaggcugggccuuugacgauggaaaugacguguggaugggaagaacgaucagcgaggagucacgcucagguuaugaaaccuucaaagucauuggugguugguccacaccuaauuccaaauugcagauaaauaggcaagucauaguugacagcgauaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcacuucagguaccuaugggacaggcucauggccugauggagcggacaucaaucucaugccuauauaa

SEQ ID NO: 45178 - RNA, 1410 nt, Artificial Sequence
  neuraminidase__InfluenzaA__ABC46579
augaauccaaaucaaaagauaauaacaauuggcucugucucucucaccauugcaacaauaugcuuccuuaugcaaauugccauccugguaacuacuguaacauugcauuucaagcaauaugagugcagcucccccccaaacaaccaaguaaugccgugugaaccaauaauaauagaaagaaacauaacagagauaguguauuugacuaacaccaccauagagaaagagauaugccccaaacuaguggaauacagaaauuggucaaagccgcaauguaaaauuacaggauuugcacccuuuucuaaggacaauucaauucggcuuucugcugguggggacauuugggugacgagagaaccuuaugugucaugcgauccuggcaaguguuaucaauuugcacucgggcaggggaccacacuagacaacaagcauucaaaugacacaauacaugauaggaccccuuaucgaacccuauugaugaaugaguuggguguuccauuucauuugggaaccaggcaaguguguauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaauuguucacauuagcccauugucaggaagugcucagcauguagaggaguguuccuguuauccucgauauccuggugucagaugugucugcagagacaacuggaaaggcuccaauaggcccgucguagauauaaaugugaaagauuauagcauuguuuccaguuaugugugcucagggcuuguuggcgacacacccagaaaaaacgacagaucuagcaguagcuauugccggaauccuaacaaugagaaagggaaucauggagugaaaggcugggccuuugacgauggaaaugacguguggaugggaagaacgaucagugaggagucacgcucagguuaugaaaccuucaaagucauuggugguugguccacaccuaauuccaaauugcagauaaauaggcaagucauaguugacagcgauaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcacuucagguaccuauggaacaggcucauggccugauggagcggacaucaaucucaugccuauauaa

SEQ ID NO: 45179 - RNA, 1410 nt, Artificial Sequence; identical to SEQ ID NO: 45018
  neuraminidase__InfluenzaA__ABC50170

SEQ ID NO: 45180 - RNA, 1410 nt, Artificial Sequence; identical to SEQ ID NO: 45018
  neuraminidase__InfluenzaA__ABC50181

SEQ ID NO: 45181 - RNA, 1410 nt, Artificial Sequence; identical to SEQ ID NO: 45018
  neuraminidase__InfluenzaA__ABC50192

SEQ ID NO: 45182 - RNA, 1410 nt, Artificial Sequence; identical to SEQ ID NO: 44670
  neuraminidase__InfluenzaA__ABC50203

SEQ ID NO: 45183 - RNA, 1410 nt, Artificial Sequence
  neuraminidase__InfluenzaA__ABC50214
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucauagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaaccccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45184 - RNA, 1410 nt, Artificial Sequence; identical to SEQ ID NO: 44670
  neuraminidase__InfluenzaA__ABC50225

SEQ ID NO: 45185 - RNA, 1410 nt, Artificial Sequence; identical to SEQ ID NO: 44670
  neuraminidase__InfluenzaA__ABC50247

SEQ ID NO: 45186 - RNA, 1410 nt, Artificial Sequence
  neuraminidase__InfluenzaA__ABC50258
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauacccuggugucagaugugucugcagagacaacuggaaaggcuccaauaggcccaucauagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccauugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45187 - RNA, 1410 nt, Artificial Sequence; identical to SEQ ID NO: 44670
  neuraminidase__InfluenzaA__ABC50280

SEQ ID NO: 45188 - RNA, 1410 nt, Artificial Sequence
  neuraminidase__InfluenzaA__ABC50291
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcacgucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacaggucugguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45189 - RNA, 1410 nt, Artificial Sequence
  neuraminidase__InfluenzaA__ABC50302
augaauccaaaucaaaagauaauaacaauuggcucuguuucucucaccauugccacaauaugcuuccuuaugcaaauugccauccugauaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45190 - RNA, 1410 nt, Artificial Sequence
  neuraminidase__InfluenzaA__ABC50313
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45191 - RNA, 1410 nt, Artificial Sequence; identical to SEQ ID NO: 44670
  neuraminidase__InfluenzaA__ABC50324

SEQ ID NO: 45192 - RNA, 1410 nt, Artificial Sequence
  neuraminidase__InfluenzaA__ABC50335
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaauaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuccauuugggaaccaggcaagugugcauagcaugguccagcucaaguugucaugauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45193 - RNA, 1410 nt, Artificial Sequence
  neuraminidase__InfluenzaA__ABC50346
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucauagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45194 - RNA, 1410 nt, Artificial Sequence; identical to SEQ ID NO: 44670
  neuraminidase__InfluenzaA__ABC50357

SEQ ID NO: 45195 - RNA, 1410 nt, Artificial Sequence
  neuraminidase__InfluenzaA__ABC50368
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuggcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45196 - RNA, 1410 nt, Artificial Sequence; identical to SEQ ID NO: 44670
  neuraminidase__InfluenzaA__ABC50379

SEQ ID NO: 45197 - RNA, 1410 nt, Artificial Sequence
  neuraminidase__InfluenzaA__ABC50390
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaagguuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45198 - RNA, 1410 nt, Artificial Sequence
  neuraminidase__InfluenzaA__ABC50412
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacauuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagauccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucguggccugauggggcggacaucaaucucaugccuauauaa

SEQ ID NO: 45199 - RNA, 1410 nt, Artificial Sequence; identical to SEQ ID NO: 45198
  neuraminidase__InfluenzaA__ABC50423

SEQ ID NO: 45200 - RNA, 1410 nt, Artificial Sequence; identical to SEQ ID NO: 44785
  neuraminidase__InfluenzaA__ABC54671

SEQ ID NO: 45201 - RNA, 1410 nt, Artificial Sequence; identical to SEQ ID NO: 44915
  neuraminidase__InfluenzaA__ABC54682

SEQ ID NO: 45202 - RNA, 1410 nt, Artificial Sequence; identical to SEQ ID NO: 45095
  neuraminidase__InfluenzaA__ABC67322

SEQ ID NO: 45203 - RNA, 1410 nt, Artificial Sequence; identical to SEQ ID NO: 44670
  neuraminidase__InfluenzaA__ABC67474

SEQ ID NO: 45204 - RNA, 1410 nt, Artificial Sequence; identical to SEQ ID NO: 45193
  neuraminidase__InfluenzaA__ABC67546

SEQ ID NO: 45205 - RNA, 1410 nt, Artificial Sequence
  neuraminidase__InfluenzaA__ABC67557
augaauccaaaucaaaagauaauaacgauuggcucugugucucucaccauuuccacaauaugcuucuucaugcaaauugccaucuugguaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaacgcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggcaaagcugauacuaaaauacuauucauugaggaggggaaaauaguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacaccuagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45206 - RNA, 1410 nt, Artificial Sequence
  neuraminidase__InfluenzaA__ABC67568
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacaggaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauccucaggacccaggagucggaaugcguuuguaucaaugggacuuguacaguaguaaugacugauggaagugcuucaggaagagcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaauagcuauugccggaauccuaacaaugagaaagggaaucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcgaacaucaaucucaugccuauauaa

SEQ ID NO: 45207 - RNA, 1410 nt, Artificial Sequence
  neuraminidase__InfluenzaA__ABC67579
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaaccagcagaauacagaaauuggucaaagccgcaauguaaaauuacaggauuugcaccuuuuucaaaggacaauucaauucggcuuuccgcugguggggacauuugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuuaggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagccaauugucaggaagugcucagcaugucgaggagugcuccuguuauccucgauauccuggugucagaugugucugcagagacaacuggaaaggcuccaauaggcccaucguagauauaaauguaaaggaucauagcauuguuuccaguuaugugugcucaggacuuguuggagacacacccagaaaaaacgacagcuccagcaguagccauugccugaauccuaacaaugaagaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuugugguaccucagguacauauggaacaggcucauggccugauggggcggacaucaaucucaugccuauauaa

SEQ ID NO: 45208 - RNA, 1410 nt, Artificial Sequence; identical to SEQ ID NO: 44870
  neuraminidase__InfluenzaA__ABC67590

SEQ ID NO: 45209 - RNA, 1410 nt, Artificial Sequence; identical to SEQ ID NO: 44870
  neuraminidase__InfluenzaA__ABC67601

SEQ ID NO: 45210 - RNA, 1410 nt, Artificial Sequence; identical to SEQ ID NO: 44670
  neuraminidase__InfluenzaA__ABC67612

SEQ ID NO: 45211 - RNA, 1410 nt, Artificial Sequence; identical to SEQ ID NO: 44670
  neuraminidase__InfluenzaA__ABC67623

SEQ ID NO: 45212 - RNA, 1410 nt, Artificial Sequence
  neuraminidase__InfluenzaA__ABC67634
augaauccaaaucaaaagauaauaacaauuggcucuguuucucucaccauugccacaauaugcuuccuuaugcaaauugccauccugguaacuacuguaacauugcauuucaagcaguaugaaugcaacccccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45213 - RNA, 1410 nt, Artificial Sequence; identical to SEQ ID NO: 44670
  neuraminidase__InfluenzaA__ABC67645

SEQ ID NO: 45214 - RNA, 1410 nt, Artificial Sequence
  neuraminidase__InfluenzaA__ABC67656
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggaguaaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45215 - RNA, 1410 nt, Artificial Sequence
  neuraminidase__InfluenzaA__ABC67700
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacucuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45216 - RNA, 1410 nt, Artificial Sequence
  neuraminidase__InfluenzaA__ABC67711
augaauccaaaucaaaagauaauaacgauugguucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45217 - RNA, 1410 nt, Artificial Sequence
  neuraminidase__InfluenzaA__ABC67736
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcguagcaugguccagcucaaguugucacgauggaaaagcauggcugcauguuuguguaacgggggaugauaaaaaugcaacugcuaguuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45218 - RNA, 1410 nt, Artificial Sequence
  neuraminidase__InfluenzaA__ABC67809
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45219 - RNA, 1410 nt, Artificial Sequence
  neuraminidase__InfluenzaA__ABC67820
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45220 - RNA, 1410 nt, Artificial Sequence; identical to SEQ ID NO: 45074
  neuraminidase__InfluenzaA__ABC67842

SEQ ID NO: 45221 - RNA, 1410 nt, Artificial Sequence; identical to SEQ ID NO: 44670
  neuraminidase__InfluenzaA__ABC67853

SEQ ID NO: 45222 - RNA, 1410 nt, Artificial Sequence; identical to SEQ ID NO: 45074
  neuraminidase__InfluenzaA__ABC67864

SEQ ID NO: 45223 - RNA, 1410 nt, Artificial Sequence; identical to SEQ ID NO: 45193
  neuraminidase__InfluenzaA__ABC67886

SEQ ID NO: 45224 - RNA, 1410 nt, Artificial Sequence; identical to SEQ ID NO: 44670
  neuraminidase__InfluenzaA__ABC67897

SEQ ID NO: 45225 - RNA, 1410 nt, Artificial Sequence
  neuraminidase__InfluenzaA__ABC67970
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaguguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45226 - RNA, 1410 nt, Artificial Sequence
  neuraminidase__InfluenzaA__ABC67981
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucaauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45227 - RNA, 1410 nt, Artificial Sequence
  neuraminidase__InfluenzaA__ABC67992
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacaacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaauugaagucugguggaccucaaacaguauuguuguguuuuguggcaccucagguacauauggaacaggcucauggccugauggggcggauaucaaucucaugccuauauaa

SEQ ID NO: 45228 - RNA, 1410 nt, Artificial Sequence; identical to SEQ ID NO: 45193
  neuraminidase__InfluenzaA__ABC68003

SEQ ID NO: 45229 - RNA, 1410 nt, Artificial Sequence
  neuraminidase__InfluenzaA__ABC68052
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugauugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaagguuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45230 - RNA, 1410 nt, Artificial Sequence; identical to SEQ ID NO: 44670
  neuraminidase__InfluenzaA__ABC68063

SEQ ID NO: 45231 - RNA, 1410 nt, Artificial Sequence; identical to SEQ ID NO: 44670
  neuraminidase__InfluenzaA__ABC68074

SEQ ID NO: 45232 - RNA, 1410 nt, Artificial Sequence
  neuraminidase__InfluenzaA__ABC68085
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45233 - RNA, 1410 nt, Artificial Sequence
  neuraminidase__InfluenzaA__ABC68096
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagaaauaguguaucugaccaauaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaaugggacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacauauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45234 - RNA, 1410 nt, Artificial Sequence
  neuraminidase__InfluenzaA__ABC68225
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaagcugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45235 - RNA, 1410 nt, Artificial Sequence; identical to SEQ ID NO: 45023
  neuraminidase__InfluenzaA__ABC68236

SEQ ID NO: 45236 - RNA, 1350 nt, Artificial Sequence
  neuraminidase__InfluenzaA__ABC72646
augaauccgaauaagaagauaauaaccaucggaucaaucuguaugguaacuggaaugguuagcuuaauguuacaaauugggaacuugaucucaauaugggucagucauucaauucacacagggaaucaacagaaagcugaaccaaucagcaauacuaauuuucuuacugagaaagcuguggcuucaguaaaauuagcgggcaauucaucucuuugcccuauuaaugggugggcuguauacaguaaggacaacaguauaaggaucgguuccaagggggauguguuuguuauaagagagccauucaucucaugcucccacuuggaaugcagaacuuucuuuuugacucagggauccuugcugaaugacaagcacuccaaugggacugucaaagacaggaguccucacagaacauuaaugaguuguccugugggugaggcucccuccccauauaacucaagguuugagucuguugcuuggucagcaagugcuugccaugauggcaccaguugguugacaauuggaauuucuggcccagacaguggggcuguggcuguauugaaauacaauggcauaauaacagacacuaucaagaguuggaggaauaacauacugagaacucaagagucugaaugugcauguguaaauggcucuugcuuuacuguaaugacugacggaccaaguaauggucaggcaucacauaagaucuucaaaauggacaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacacuccacgccccaaugauggaacagguaguugugguccgguguccucuaacgggacauaugggguaaaaggguuuucauuuaaauacggcaauggugucuggaucgggagaacaaaaagcacuaauuccagaagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugcccuucaccauugacaaguag

SEQ ID NO: 45237 - RNA, 1410 nt, Artificial Sequence; identical to SEQ ID NO: 44603
  neuraminidase__InfluenzaA__ABC84392

SEQ ID NO: 45238 - RNA, 1410 nt, Artificial Sequence; identical to SEQ ID NO: 45029
  neuraminidase__InfluenzaA__ABC84403

SEQ ID NO: 45239 - RNA, 1410 nt, Artificial Sequence; identical to SEQ ID NO: 45018
  neuraminidase__InfluenzaA__ABC84414

SEQ ID NO: 45240 - RNA, 1410 nt, Artificial Sequence
  neuraminidase__InfluenzaA__ABC84425
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaggugaugcugugugaaccaacaauaauagaaagaaacauaacagagauaguguaucugaccaacaccaccauagagaaggaaauaugccccaaacuagcggaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacaggggacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauugucaggaagugcucagcaugucgaggaguguuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaaacugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45241 - RNA, 1410 nt, Artificial Sequence; identical to SEQ ID NO: 44870
  neuraminidase__InfluenzaA__ABC84436

SEQ ID NO: 45242 - RNA, 1410 nt, Artificial Sequence
  neuraminidase__InfluenzaA__ABC84447
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauagugcaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45243 - RNA, 1410 nt, Artificial Sequence; identical to SEQ ID NO: 45218
  neuraminidase__InfluenzaA__ABC84501

SEQ ID NO: 45244 - RNA, 1410 nt, Artificial Sequence
  neuraminidase__InfluenzaA__ABC84512
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagagagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45245 - RNA, 1410 nt, Artificial Sequence
  neuraminidase__InfluenzaA__ABC84523
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggagacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuugcagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaagaaacugaagucuuguggaccucaaacaguauuguuguguuuuguggcaccucagguacauauggaacaggcucauggccugauggggcggacaucaaucucaugccuauauaa

SEQ ID NO: 45246 - RNA, 1410 nt, Artificial Sequence
  neuraminidase__InfluenzaA__ABC84545
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacaggaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauccucaggacccaggagucggaaugcguuuguaucaaugggacuuguacaguaguaaugacugauggaagugcuucaggaagcgcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagaucauagcauugauuccaguuaugugugcucagggcuuguuggcgacacacccagaaacaacgacagaucuagcaauagcuauugccggaauccuaacaaugagaaagggaaucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauagguguuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 45247 - RNA, 1410 nt, Artificial Sequence
  neuraminidase__InfluenzaA__ABC84574
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45248 - RNA, 1410 nt, Artificial Sequence; identical to SEQ ID NO: 45234
  neuraminidase__InfluenzaA__ABC85757

SEQ ID NO: 45249 - RNA, 1410 nt, Artificial Sequence; identical to SEQ ID NO: 45245
  neuraminidase__InfluenzaA__ABC85768

SEQ ID NO: 45250 - RNA, 1410 nt, Artificial Sequence; identical to SEQ ID NO: 45247
  neuraminidase__InfluenzaA__ABC85779

SEQ ID NO: 45251 - RNA, 1410 nt, Artificial Sequence; identical to SEQ ID NO: 45234
  neuraminidase__InfluenzaA__ABC85790

SEQ ID NO: 45252 - RNA, 1410 nt, Artificial Sequence; identical to SEQ ID NO: 45218
  neuraminidase__InfluenzaA__ABC85801

SEQ ID NO: 45253 - RNA, 1410 nt, Artificial Sequence
  neuraminidase__InfluenzaA__ABC85812
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45254 - RNA, 1410 nt, Artificial Sequence; identical to SEQ ID NO: 45245
  neuraminidase__InfluenzaA__ABC85823

SEQ ID NO: 45255 - RNA, 1410 nt, Artificial Sequence; identical to SEQ ID NO: 45217
  neuraminidase__InfluenzaA__ABC85834

SEQ ID NO: 45256 - RNA, 1410 nt, Artificial Sequence; identical to SEQ ID NO: 45218
  neuraminidase__InfluenzaA__ABC85845

SEQ ID NO: 45257 - RNA, 1410 nt, Artificial Sequence; identical to SEQ ID NO: 45245
  neuraminidase__InfluenzaA__ABC85856

SEQ ID NO: 45258 - RNA, 1410 nt, Artificial Sequence; identical to SEQ ID NO: 45217
  neuraminidase__InfluenzaA__ABC85867

SEQ ID NO: 45259 - RNA, 1410 nt, Artificial Sequence
  neuraminidase__InfluenzaA__ABC85900
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggauggggagaacaaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45260 - RNA, 1410 nt, Artificial Sequence
  neuraminidase__InfluenzaA__ABC85911
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacauguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45261 - RNA, 1410 nt, Artificial Sequence
  neuraminidase__InfluenzaA__ABC85922
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaacaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauucugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45262 - RNA, 1410 nt, Artificial Sequence; identical to SEQ ID NO: 44670
  neuraminidase__InfluenzaA__ABC85933

SEQ ID NO: 45263 - RNA, 1410 nt, Artificial Sequence
  neuraminidase__InfluenzaA__ABC85955
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucgcaugccuauauaa

SEQ ID NO: 45264 - RNA, 1410 nt, Artificial Sequence; identical to SEQ ID NO: 44670
  neuraminidase__InfluenzaA__ABC85966

SEQ ID NO: 45265 - RNA, 1410 nt, Artificial Sequence; identical to SEQ ID NO: 44670
  neuraminidase__InfluenzaA__ABC85977

SEQ ID NO: 45266 - RNA, 1410 nt, Artificial Sequence
  neuraminidase__InfluenzaA__ABC85988
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaagggaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45267 - RNA, 1410 nt, Artificial Sequence; identical to SEQ ID NO: 44870
  neuraminidase__InfluenzaA__ABC85999

SEQ ID NO: 45268 - RNA, 1410 nt, Artificial Sequence; identical to SEQ ID NO: 44870
  neuraminidase__InfluenzaA__ABC86010

SEQ ID NO: 45269 - RNA, 1410 nt, Artificial Sequence
  neuraminidase__InfluenzaA__ABC86021
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 45270 - RNA, 1410 nt, Artificial Sequence
  neuraminidase__InfluenzaA__ABC86127
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaguacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45271 - RNA, 1410 nt, Artificial Sequence
  neuraminidase__InfluenzaA__ABC86140
augaauccaaaucaaaagauaauaacaauuggcucugucucucucaccauugcaacaauaugcuuccuuaugcaaauugccauccugguaacuacuguaacauugcauuucaagcaauaugagugcagcucccccccaaacaaccaaguaaugccgugugaaccaauaauaauagaaagaaacauaacagagauaguguauuugacuaacaccaccauagagaaagagauaugccccaaacuaguggaauacagaaauuggucaaagccgcaauguaaaauuacaggauuugcacccuuuucuaaggacaauucaauucggcuuucugcugguggggacauuugggugacgagagaaccuuaugugucaugcgauccuggcaaguguuaucaauuugcacucgggcaggggaccacacuagacaacaagcauucaaaugacacaauacaugauaggaccccuuaucgaacccuauugaugaaugaguuggguguuccauuucauuugggaaccaggcaaguguguauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggaguguuccuguuauccucgauauccuggugucagaugugucugcagagacaacuggaaaggcuccaauaggcccgucguagauauaaaugugaaagauuauagcauuguuuccaguuaugugugcucagggcuuguuggcgacacacccagaaaaaacgacagaucuagcaguagcuauugccggaauccuaacaaugagaaagggaaucauggagugaaaggcugggccuuugacgauggaaaugacguguggaugggaagaacgaucagugaggagucacgcucagguuaugaaaccuucaaagucauuggugguugguccacaccuaauuccaaauugcagauaaauaggcaagucauaguugacagcgauaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcacuucagguaccuauggaacaggcucauggccugauggagcggacaucaaucucaugccuauauaa

SEQ ID NO: 45272 - RNA, 1410 nt, Artificial Sequence
  neuraminidase__InfluenzaA__ABC86151
augaauccaaaucaaaagauaauaacaauuggcucuguuucucucaccauugcaacaauaugcuuccuuaugcaaauugccauccugguaacuacuguaacauugcauuucaagcaauaugagugcagcucccccccaaacaaccaaguaaugccgugugaaccaauaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacgagagaaccuuaugugucaugcgauccuggcaaguguuaucaauuugcacuugggcagggaaccacacuaaacaacaagcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggaguguuccuguuauccucgauauccuggugucagaugugucugcagagacaacuggaaaggcuccaauaggcccaucguagauauaaaugugaaagauuauagcauuguuuccaguuaugugugcucagggcuuguuggcgacacacccagaaaaaacgacagauccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggugguugguccacaccuaacuccaaauugcagauaaauaggcaagucauaguugacagcgguaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcaccucagguacauauggaacaggcucauggccugauggagcggacaucaaucucaugccuauauaa

SEQ ID NO: 45273 - RNA, 1413 nt, Artificial Sequence
  neuraminidase__InfluenzaA__ABC86240
augaauccaaaucaaaaaauaauaaccauuggaucaaucaguguggcaaucggaauaauuagucuaauauugcaaauaggaaauauuauuucaauaugggcuagccacucaauccaaacuggaagucaaaacuacacuggaauaugcaaccaaaaaaucauuacauaugaaaauagaaccuggguaaaucaaacauauguuaauauuaacaacacuaauguuguugcuggaaaggacaaaaccucgaugacauuggccggcaauucaucucuuugcccuauccguggaugggcaauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccauuaaggacagaagcccuuuuagggccuuaaugagcuguccucugggugaagcuccgucuccauacaauucaagauuugaaucaguugcuuggucagcaagcgcaugccaugauggccugggcuggcuaacaaucggaauuucugguccagauaauggagcaguggcuguacuaaaauacaacggcauaauaacugaaaccauaaaaaguuggaaaaagcaaauccuaagaacacaagagucugaaugugucugugugaacgguucauguuuuaccauaaugaccgauggcccgaguaacagggccgcaucguacagaaucuucaaaauugagaaggggagaguuacuaaaucaauagaguuggaugcacccaauuaccauuacgaggaauguuccuguuauccagacaccggcacaguaaugugugugugcagggacaauuggcacgguucaaaucgaccuuggguguccuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacuaagaaagggauuugagaugauuugggauccuaauggauggacagauaccgacagugauuucucaaugaaacaggaugucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcgugaauagcgagacugcaaacuggucuuggccagacggugcugaguugccauucaccauugacaaguag

SEQ ID NO: 45274 - RNA, 1410 nt, Artificial Sequence
  neuraminidase__InfluenzaA__ABC97377
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacaggaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauccucaggacccaggagucggaaugcguuuguaucaaugggacuuguacaguaguaaugacugauggaagugcuucaggaagcgcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaauagcuauugccggaauccuaacaaugagaaagggaaucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauagguguuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 45275 - RNA, 1410 nt, Artificial Sequence
  neuraminidase__InfluenzaA__ABD15452
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggugacaucugggugacaagagaaccuuaugugucaugcgacccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaguguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 45276 - RNA, 1410 nt, Artificial Sequence
  neuraminidase__InfluenzaA__ABD15463
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45277 - RNA, 1410 nt, Artificial Sequence; identical to SEQ ID NO: 44709
  neuraminidase__InfluenzaA__ABD15474

SEQ ID NO: 45278 - RNA, 1410 nt, Artificial Sequence
  neuraminidase__InfluenzaA__ABD15485
augaauccaaaucaaaagauaauaacaauuggcucuguuucucucaccauugccacaauaugcuuccuuaugcaaauugccaucuugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucuggcauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcgaacaucaaucucaugccuauauaa

SEQ ID NO: 45279 - RNA, 1410 nt, Artificial Sequence
  neuraminidase__InfluenzaA__ABD15496
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugagccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45280 - RNA, 1410 nt, Artificial Sequence
  neuraminidase__InfluenzaA__ABD15507
augaauccaaaucaaaagauaauaacaauuggcucuguuucucucaccauugccacaauaugcuuccuuaugcaaauugccaucuugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaacuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucuggcauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 45281 - RNA, 1413 nt, Artificial Sequence
  neuraminidase__InfluenzaA__ABD15518
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaaugggggcgccucguacaaaaucuucaagaucgaaaaggggaagguuacuaaaucaauagaguugaaugcacccaauuuccauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 45282 - RNA, 1410 nt, Artificial Sequence; identical to SEQ ID NO: 44836
  neuraminidase__InfluenzaA__ABD15529

SEQ ID NO: 45283 - RNA, 1410 nt, Artificial Sequence; identical to SEQ ID NO: 45018
  neuraminidase__InfluenzaA__ABD15551

SEQ ID NO: 45284 - RNA, 1410 nt, Artificial Sequence
  neuraminidase__InfluenzaA__ABD15562
augaauccaaaucaaaagauaauaacgauuggcucuguuucucucacuauugccacaauaugcuuccuuaugcaaauugccauccugguaacuacuguaacauugcauuucaagcaauaugaaugcagcucucccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagggaaccuuaugugucgugugauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaauaguaaugacugaugggagugcuucaggaagagcugauacuaaaauacuauucauugaggaggggaaaaucguucauaucagcccacugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagucauugccugaauccuaacaaugaggaagggggucauggagugaaaggcugggccuuugaugauggaaaugacguguggaugggaagaacgaucagcgagaaguuccgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45285 - RNA, 1410 nt, Artificial Sequence
  neuraminidase__InfluenzaA__ABD15573
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucaaaggacaauucaauucggcuuuccgcugguggggacauuugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuuaggaaccaagcaagugugcauggcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagccaauugucaggaagugcucagcaugucgaggagugcuccuguuauccucgauauccuggugucagaugugucugcagagacaacuggaaaggcuccaauaggcccaucguagauauaaauguaaaggaucauagcauuguuuccaguuaugugugcucaggacuuguuggagacacacccagaaaaaacgacagcuccagcaguagccauugccugaauccuaacaaugaagaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuugugguaccucagguacauauggaacaggcucauggccugauggggcggacaucaaucucaugccuauauaa

SEQ ID NO: 45286 - RNA, 1410 nt, Artificial Sequence
  neuraminidase__InfluenzaA__ABD15584
augaauccaaaucaaaagauaauaacgauuggcucuguuucucucacuauugccacaauaugcuuccuuaugcaaauugccauccugguaacuacuguaacauugcauuucaagcaauaugaaugcagcucucccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagggaaccuuaugugucgugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauaucagcccacugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagucauugccugaauccuaacaaugaggaagggggucauggagugaaaggcugggccuuugaugaugaaaaugacguguggaugggaagaacgaucagcgagaaguuccgcucagguuaugaaaccuucaaagucauugaaggcugguccaaaccuaacuccaaauugcagauaaacaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuauuguguuuuguggcaccucagguacauauggaacaggcucauggccugauggggcggacaucaaucucaugccuauauaa

SEQ ID NO: 45287 - RNA, 1410 nt, Artificial Sequence
  neuraminidase__InfluenzaA__ABD15595
augaauccaaaucaaaagauaauaacgauuggcucuguuucucucacuauugccacaauaugcuuccuuaugcaaauugccauccugguaacuacuguaacauugcauuucaagcaauaugaaugcaacucccccccgaacaaccaaguaaugcugugugaaccaacaauaauagaaagaaauauaacagagauaguguaucugaccaacaccaccauagagaaggaaauaugccccaaacuagcagaauacagaaauuggucaaagccgcaauguaaaauuacaggauuugcaccuuuuucaaaggacaauucaauucggcuuucagcugguggggacauuugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuuaggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagccaauugucaggaagugcucagcaugucgaggagugcuccuguuauccucgauauccuggugucagaugugucugcagagacaacuggaaaggcuccaauaggcccaucguagauauaaauguaaaggaucauagcauuguuuccaguuaugugugcucaggacuuguuggagacacacccagaaaaaacgacagcuccagcaguagccauugccugaauccuaacaaugaagaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuugugguaccucagguacauauggaacaggcucauggccugauggggcggacaucaaucucaugccuauauaa

SEQ ID NO: 45288 - RNA, 1410 nt, Artificial Sequence
  neuraminidase__InfluenzaA__ABD15606
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucaaaggacaauucaauucggcuuuccgcugguggggacauuugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuuaggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagccaauugucaggaagugcucagcaugucgaggagugcuccuguuauccucgauauccuggugucagaugugucugcagagacaacuggaaaggcuccaauaggcccaucguagauauaaauguaaaggaucauagcauuguuuccaguuaugugugcucaggacuuguuggagacacacccagaaaaaacgacagcuccagcaguagccauugccugaauccuaacaaugaagaagggggucauggagugaaaggcugggccuuugaugauggaaaugacguguggaugggaagaacaaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuugugguaccucagguacauauggaacaggcucauggccugauggggcggacaucaaucucaugccuauauaa

SEQ ID NO: 45289 - RNA, 1410 nt, Artificial Sequence; identical to SEQ ID NO: 45018
  neuraminidase__InfluenzaA__ABD15617

SEQ ID NO: 45290 - RNA, 1410 nt, Artificial Sequence
  neuraminidase__InfluenzaA__ABD15639
augaauccaaaucaaaagauaauaacgauuggcucuguuucucucacuauugccacaauaugcuuccuuaugcaaauugccauccugguaacuacuguaacauugcauuucaagcaauaugaaugcagcucucccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagggaaccuuaugugucgugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauaucagcccacugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagucauugccugaauccuaacaaugaggaagggggucauggagugaaaggcugggccuuugaugauggaaaugacguguggaugggaagaacgaucagcgagaaguuccgcucagguuaugaaaccuucaaagucauugaaggcugguccaaaccuaauuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45291 - RNA, 1410 nt, Artificial Sequence; identical to SEQ ID NO: 45247
  neuraminidase__InfluenzaA__ABD15650

SEQ ID NO: 45292 - RNA, 1410 nt, Artificial Sequence
  neuraminidase__InfluenzaA__ABD15661
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauucuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagaggcaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45293 - RNA, 1410 nt, Artificial Sequence; identical to SEQ ID NO: 45247
  neuraminidase__InfluenzaA__ABD15683

SEQ ID NO: 45294 - RNA, 1410 nt, Artificial Sequence; identical to SEQ ID NO: 45292
  neuraminidase__InfluenzaA__ABD15694

SEQ ID NO: 45295 - RNA, 1410 nt, Artificial Sequence; identical to SEQ ID NO: 45247
  neuraminidase__InfluenzaA__ABD15705

SEQ ID NO: 45296 - RNA, 1410 nt, Artificial Sequence; identical to SEQ ID NO: 45247
  neuraminidase__InfluenzaA__ABD15727

SEQ ID NO: 45297 - RNA, 1410 nt, Artificial Sequence
  neuraminidase__InfluenzaA__ABD15749
augaauccaaaucaaaagauaauaacgauuggcucuguuucucucaccauugccacaauaugcuuccuuaugcaaauugccguccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaccaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45298 - RNA, 1410 nt, Artificial Sequence
  neuraminidase__InfluenzaA__ABD15760
augaauccaaaucaaaagauaauaacgauuggcucuguuucucucaccauugccacaauaugcuuccuuaugcaaauugccguccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaccaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggaaucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45299 - RNA, 1410 nt, Artificial Sequence
  neuraminidase__InfluenzaA__ABD15771
augaauccaaaucaaaagauaauaacgauuggcucuguuucucucacaauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45300 - RNA, 1410 nt, Artificial Sequence; identical to SEQ ID NO: 45247
  neuraminidase__InfluenzaA__ABD15782

SEQ ID NO: 45301 - RNA, 1410 nt, Artificial Sequence; identical to SEQ ID NO: 45247
  neuraminidase__InfluenzaA__ABD15793

SEQ ID NO: 45302 - RNA, 1410 nt, Artificial Sequence; identical to SEQ ID NO: 45218
  neuraminidase__InfluenzaA__ABD16306

SEQ ID NO: 45303 - RNA, 1410 nt, Artificial Sequence
  neuraminidase__InfluenzaA__ABD16317
augaauccaaaucaaaagauaauaacgauuggcucuguuucucucaccauuucuacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugggggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuucuaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45304 - RNA, 1410 nt, Artificial Sequence
  neuraminidase__InfluenzaA__ABD16328
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcuacauguuuguguaacgggggaugauaaaaaugcaacugcuagcuucauuuacaaugggaggcuuguagauaguauuguuucaugguccaaaaaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuauguuugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45305 - RNA, 1410 nt, Artificial Sequence
  neuraminidase__InfluenzaA__ABD16339
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguggccauugcuuggauccuaacaaugaagaagguggucauggagugaaaggcugggccuuugaugauggaaaugacguguggaugggaagaacgaucagcgagaaauuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45306 - RNA, 1410 nt, Artificial Sequence
  neuraminidase__InfluenzaA__ABD16361
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaagcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45307 - RNA, 1410 nt, Artificial Sequence; identical to SEQ ID NO: 45218
  neuraminidase__InfluenzaA__ABD16475

SEQ ID NO: 45308 - RNA, 1410 nt, Artificial Sequence; identical to SEQ ID NO: 45218
  neuraminidase__InfluenzaA__ABD16486

SEQ ID NO: 45309 - RNA, 1410 nt, Artificial Sequence; identical to SEQ ID NO: 45245
  neuraminidase__InfluenzaA__ABD16497

SEQ ID NO: 45310 - RNA, 1410 nt, Artificial Sequence; identical to SEQ ID NO: 45218
  neuraminidase__InfluenzaA__ABD16508

SEQ ID NO: 45311 - RNA, 1410 nt, Artificial Sequence
  neuraminidase__InfluenzaA__ABD16519
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcucaaauaggcccauuguagauauaaacauaaaggauuauagcauuguuuccaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaaguugcaucaaucggugcuuuuauguggaguugauaaggggaagaaaagaggaaacugaagucuuguggaccucaaacaguauuguuguauuuuguggaaccucagguacauauggaacaggcucauggccugauggggcggacaucaaucucaugccuauauaa

SEQ ID NO: 45312 - RNA, 1410 nt, Artificial Sequence
  neuraminidase__InfluenzaA__ABD16530
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagaugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45313 - RNA, 1410 nt, Artificial Sequence; identical to SEQ ID NO: 45095
  neuraminidase__InfluenzaA__ABD16541

SEQ ID NO: 45314 - RNA, 1410 nt, Artificial Sequence; identical to SEQ ID NO: 45218
  neuraminidase__InfluenzaA__ABD16552

SEQ ID NO: 45315 - RNA, 1410 nt, Artificial Sequence; identical to SEQ ID NO: 45217
  neuraminidase__InfluenzaA__ABD16563

SEQ ID NO: 45316 - RNA, 1410 nt, Artificial Sequence
  neuraminidase__InfluenzaA__ABD16574
augaauccaaaucaaaagauaauaacaauuggcucuguuucucucaccauugccacaauaugcuuccuuaugcaaauugccauccugguaacuacuguaacauugcauuucaagcaauaugagugcagcucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaagauuacaggauuugcaccuuuuucuaaggacaauucaauucggcuuuccgcugguggagauauuugggugacaagagaaccuuaugugucaugcgauccuggcaaguguuaucaauuugcacuugggcagggaaccacccuaaacaacaggcauucaaaugacacaguacaugauaggaccccuuaucgaacccucuugaugaaugaguuggguguuccauuucauuugggaaccaagcaaguaugcauagcaugguccagcucaaguugucacgauggaaaagcauggcugcauguuugugucacugggcaugaugaaaaugcaacugcuagcuucauuuacgaugggaggcuuguagacaguauugguucaugguccaaaaauauccucaggacccaggagucugaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuggucggagacacacccagaaaaaacgacagauccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaaggaaaaaggaaacuagagucugguggaccucaaacaguauuguuguguuuuguggcaccucagguacauauggaacaggcucauggccugauggggcggacaucaaucucaugccuauauaa

SEQ ID NO: 45317 - RNA, 1410 nt, Artificial Sequence
  neuraminidase__InfluenzaA__ABD16585
augaauccaaaucaaaagauaauaacaauuggcucuguuucucucaccauugccacaauaugcuuucuuaugcaaauugccauucugguaacuacuguaacauugcauuucaagcaauaugagugcagcucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuugggcagggaaccacacuaaacaacaggcauucaaaugacacaguacaugauaggaccccuuaucgaacccucuugaugaaugaguuggguguuccauuucauuugggaaccaagcaggugugcauagcaugguccagcucaaguugucacgauggaaaagcaugguugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagauccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaagggaacaggaaacuagagucugguggaccucaaacaguauuguuguguuuuguggcaccucagguacauauggaacaggcucauggccugacggggcggacaucaaucucaugccuauauaa

SEQ ID NO: 45318 - RNA, 1410 nt, Artificial Sequence
  neuraminidase__InfluenzaA__ABD16721
augaauccaaaucaaaagauaauaacaauuggcucuguuucucucaccauugcaacaauaugcuuccuuaugcaaauugccauccugguaacuacuguaacacugcauuucaagcaauaugagugcagcucccccccaaacaaucaaguaaugccgugugaaccaauaauaauagaaagaaacauaacaaagauaguguauuugacuaacaccaccauagagaaagagauaugccccaaacuaguggaauacagaaauuggucaaagccgcaauguaaaauuacaggauuugcacccuuuucuaaggacaauucaauucggcuuuccgcugguggggacauuugggugacgagagaaccuuaugugucaugcgauccuggcaaguguuaucaauuugcacucgggcagggaaccacacuaaacaacaagcauucaaaugacacaauacaugauaggaccccuuaucgaacccuauugaugaaugaguugggggucccauuucauuugggaaccaagcaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauucucaggacccaggagucggagugcguuuguaucaauggaacuuguacaguaguaaugacugauggaagugcuucagaaagagcugauacuaaaauacuauucauugaagaggggaaaaucguucauauuagcccauugucaggaagugcucagcauguagaggaguguuccuguuauccucgguauccuggugucagaugugucugcagagacaacuggaaaggcuccaauaggcccaucguagauauaaaugugaaagauuauagcauuguuuccaguuaugugugcucagggcuuguuggcgacacacccagaaaaaacgacagauccagcaguagcuauugccagaauccuaacaaugagaaagggaaucauggagugaaaggcugggccuuugacgauggaaaugacguguggaugggaagaacgauuggcgaggaguuacgcucagguuaugaaaccuucaaagucauuggugguugguccacaccuaacuccaaauugcagauaaauaggcaagucauaguugacagcaaaaauaggucagguuauucugguauuuucucuguugagggcaaaagcugcaucaauaggugcuuuuauguggaguugauaaggggaagggaacaggaaacuagagucugguggaccucaaacaguauuguuguguuuuguggcaccucagguacauauggaacaggcucauggccugauggagcggacaucaaucucaugccuauauaa

SEQ ID NO: 45319 - RNA, 1410 nt, Artificial Sequence
  neuraminidase__InfluenzaA__ABD16732
augaauccaaaucaaaagauaauaacaauuggcucuguuucucucaccauugcaacaauaugcuuccuuaugcaaauugccauccugguaacuacuguaacauugcauuucaagcaauaugagugcagcucccccccaaacaaccaaguaaugccgugugaaccaauaauaauagaaagaaacauaacagagauaguguauuugacuaacaccaccauagagaaagagauaugccccaaacuaguagaauacagaaauuggucaaaaccgcaauguaaaauuacaggauuugcaccuuuuucuaaggacaauucaauucggcuuucugcugguggagacauuugggugacgagagaaccuuaugugucaugcgauccuggcaaguguuaucaauuugcacuugggcagggaaccacacuaaacaacaagcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcgcagcauguagaggaguguuccuguuauccucgauauccuggugucagaugugucugcagagacaacuggaaaggcuccaauaggcccaucguagauauaaaugugaaagauuauagcauuguuuccaguuaugugugcucagggcuuguuggcgacacacccagaaaaaacgacagauccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggugguugguccacaccuaacuccaaauugcagauaaauaggcaagucauaguugacagcgguaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcaccucagguacauauggaacaggcucauggccugauggagcggacaucaaucucaugccuauauaa

SEQ ID NO: 45320 - RNA, 1410 nt, Artificial Sequence
  neuraminidase__InfluenzaA__ABD16743
augaauccaaaucaaaagauaauaacaauuggcucugucucucucaccauugcaacaauaugcuuccucaugcagauugccauccugguaaccacuguaacauugcauuucaagcaauaugagugcgacuccccagcgaacaaccaaguaaugccgugugaaccaauaauaauagaaaggaacauaacagagauaguguauuugacuaacaccaccauagaaaaagagauaugccccaaauugguggaauacaggaauuggucaaagccacaauguaaaauuacaggauuugcaccuuucucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucacuugggaaccaggcaaguguguauagcaugguccagcucaaguugucacgauggaaaagcauggcugcauguuugugucacuggguaugauaaaaaugcaacugcuagcuucauuuacgaugggaggcuuguagacagcauugguucauggucucaaaauauccucaggacccaggagucggaauguguuuguaucaaugggacuuguacaguaguaaugacugauggaagugcuucaggaagagcugauacuaaaauacuauucauugaagaggggaaaauuguucauacuagcccauugucaggaagugcucagcauguagaggaguguuccuguuauccucgauauccuggugucagauguaucugcagagacaacuggaaaggcucuaauaggccagucguagauauaaaugugaaagauuauagcauugauuccaguuaugugugcucagggcuugugggcgacacacccagaaacaacgacagaucuagcaguagcuauugccggaauccuaacaaugaaaaagggacucacggagugaaaggcugggccuuugacgauggaaaugacguguggaugggaagaacgaucagcgaggauucacgcucagguuaugaaaccuucaaagucauuggugguugguccacaccuaauuccaaauugcagaugaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 45321 - RNA, 1410 nt, Artificial Sequence; identical to SEQ ID NO: 45080
  neuraminidase__InfluenzaA__ABD16754

SEQ ID NO: 45322 - RNA, 1410 nt, Artificial Sequence; identical to SEQ ID NO: 45271
  neuraminidase__InfluenzaA__ABD16765

SEQ ID NO: 45323 - RNA, 1410 nt, Artificial Sequence; identical to SEQ ID NO: 44837
  neuraminidase__InfluenzaA__ABD17326

SEQ ID NO: 45324 - RNA, 1410 nt, Artificial Sequence
  neuraminidase__InfluenzaA__ABD38137
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucauagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaccugaagucugguggaccucaaacaguauuguuguguuuuguggcaccccagguacauauggaacaggcucauggccugauggggcggauaucaaucucaugccuauauaa

SEQ ID NO: 45325 - RNA, 1413 nt, Artificial Sequence
  neuraminidase__InfluenzaA__ABD60782
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuccauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 45326 - RNA, 1410 nt, Artificial Sequence
  neuraminidase__InfluenzaA__ABD60793
augaauccaaaucaaaagauaauaacaauuggcucugucucucucaccauugcaacaauaugcuuccucaugcagauugccauccugguaacuacuguaacauugcauuucaagcaauaugagugcgacucccccgugaacaaccaaguaaugccgugugaaccaauaauaauagaaaggaacauaacagagauaguguauuugacuaacaccaccauagaaaaagagauaugccccaaauuaguggaauacaggaauuggucaaagccacaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacucuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacagcauuguuucauggucucaaaauauccucaggacccaggagucggaaugcguuuguaucaaugggacuuguacaguaguaaugacugauggaagugcuucagaaagagcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaauagcuauugccggaauccuaacaaugagaaagggaaucacggagugaaaggcugggccuuugacgauggaaaugacuuguggaugggaagaacgaucagcgaggauucacgcucagguuaugaaaccuucaaagucauuggugguugguccacaccuaauuccaaauugcagauaaauaggcaagucauaguugacagcgacaauaggucagguuauucugguauuuucucuguugagggcaaaagcugcaucaauaggugcuuuuauguggaguugauaaggggaagggaacaggaaacuagaguaugguggaccucaaacaguauuauuguguuuuguggcacuucagguaccuaugggacaggcucauggccugauggggcggacaucaaucucaugccuauauaa

SEQ ID NO: 45327 - RNA, 1410 nt, Artificial Sequence; identical to SEQ ID NO: 45023
  neuraminidase__InfluenzaA__ABD60804

SEQ ID NO: 45328 - RNA, 1410 nt, Artificial Sequence; identical to SEQ ID NO: 45259
  neuraminidase__InfluenzaA__ABD60815

SEQ ID NO: 45329 - RNA, 1410 nt, Artificial Sequence; identical to SEQ ID NO: 45218
  neuraminidase__InfluenzaA__ABD60826

SEQ ID NO: 45330 - RNA, 1410 nt, Artificial Sequence
  neuraminidase__InfluenzaA__ABD60837
augaauccaaaucaaaagauaauaacgauuggcucuguuucucucaccauugccacaauaugcuuccuuaugcaaauugccguccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45331 - RNA, 1410 nt, Artificial Sequence
  neuraminidase__InfluenzaA__ABD60848
augaauccaaaucaaaagauaauaacgauugguucuguuucucucaccauugccacaauaugcuuccuuaugcaaguugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugccagcuucauuuacaaugggaggcuuguagauaguauugguucaugguccaaaaaaauccucaggacccaggagucggaaugcguuuguaucaauggaacuuguacagugguaaugacugaugggagugcuucaggaaaagcugauacuaaaauacuauucauugaggaggggaaaaucguucauacuagccuauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugauguguggaugggaagaacaaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggaguugauaaggggaaggaaacaggaaacugaaguuuuguggaccucaaacaguauuguuguguuuuguggcaccucagguacauauggaacaggcucauggccugauggggcggacaucaaucucaugccuauauaa

SEQ ID NO: 45332 - RNA, 1413 nt, Artificial Sequence
  neuraminidase__InfluenzaA__ABD60881
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 45333 - RNA, 1413 nt, Artificial Sequence
  neuraminidase__InfluenzaA__ABD60892
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagagucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaauggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuccauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 45334 - RNA, 1413 nt, Artificial Sequence; identical to SEQ ID NO: 45332
  neuraminidase__InfluenzaA__ABD60903

SEQ ID NO: 45335 - RNA, 1413 nt, Artificial Sequence; identical to SEQ ID NO: 44919
  neuraminidase__InfluenzaA__ABD60914

SEQ ID NO: 45336 - RNA, 1410 nt, Artificial Sequence
  neuraminidase__InfluenzaA__ABD60925
augaauccaaaucaaaagauaauaacaauuggcucuguuucucucaccauugccacaauaugcuuccuuaugcaaauugccaucuugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauauaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucuggcauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 45337 - RNA, 1413 nt, Artificial Sequence
  neuraminidase__InfluenzaA__ABD60947
augaauccaaaucagaaaauaauaaccauuggaucaaucuguauggcaaucggaauaauuagucuaauauugcaaauagggaauauuaucucaauauggguuagccacucaauucaaacuggaagucaaaaccauacuggaauaugcaaccaaagaaucauuaccuaugaaaauagcaccuggguaaaucaaacauauguuaauauuagcaacacuaacguuguugcuggaaaggacacaacuucaaugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggcgcucuauuaaaugacaagcauucaaaugggaccauuaaggacagaagcccuuauagggccuuaaugagcuguccuauaggugaagcuccgucuccauacaauucaagguuugaaucgguugcuuggucagcaagugcaugucaugauggcaugggcuggcuaacaaucggaauuucugguccagaugauggagcaguggcuguacuaaaauacaacggcauaauaacugaaaccauaaaaaguuggaggaagcaaauauuaagaacacaagagucugaaugugucuguguaaacgguucauguuuuaccauaaugaccgauggcccgagugaugggccggccucuuacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagaugggaaaggcagcugugauccaguaaauguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgacccagagaaaaaacaacaaucuggacuagugggagcagcauuucuuuuuguggcgugaauagugauacuguaaauuggucuuggccagacggugccgaguugccauucaccauugacaaguag

SEQ ID NO: 45338 - RNA, 1410 nt, Artificial Sequence
  neuraminidase__InfluenzaA__ABD61263
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggaaugaaaggcugggccuuugaugauggaaaugacguauggaugggaagaacgaucagcgagaaguuacgcucagguuaugaaaccuucaaagucaucgaaggcugguccaaaccuaacuccaaauuacagguaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45339 - RNA, 1410 nt, Artificial Sequence; identical to SEQ ID NO: 44709
  neuraminidase__InfluenzaA__ABD61274

SEQ ID NO: 45340 - RNA, 1410 nt, Artificial Sequence
  neuraminidase__InfluenzaA__ABD61285
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggacccccuaucggacccuauugaugaaugaguuagguguuccauuucaucuggggaccaagcaagugugcauagcaugguccagcucaaguugucaugauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggaaugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45341 - RNA, 1410 nt, Artificial Sequence; identical to SEQ ID NO: 45095
  neuraminidase__InfluenzaA__ABD61296

SEQ ID NO: 45342 - RNA, 1410 nt, Artificial Sequence; identical to SEQ ID NO: 45259
  neuraminidase__InfluenzaA__ABD61307

SEQ ID NO: 45343 - RNA, 1410 nt, Artificial Sequence
  neuraminidase__InfluenzaA__ABD61318
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauaggucugguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45344 - RNA, 1410 nt, Artificial Sequence
  neuraminidase__InfluenzaA__ABD61340
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaggcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45345 - RNA, 1410 nt, Artificial Sequence
  neuraminidase__InfluenzaA__ABD61351
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugauagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45346 - RNA, 1410 nt, Artificial Sequence
  neuraminidase__InfluenzaA__ABD61362
augaauccaaaucaaaagauaauaacgauuggcucuguuucucucaccauugccacaauaugcuuccuuaugcaaauugccauccugguaacuacuguaacauugcauuucaagcaauaugaaugcaacucucccccaaacaaccaagugaugcugugugaaccaacaauaauagaaagaaacauaacagagauaguauaucugaccaacaccaccauagagaaggaaguaugccccaaacuagcagaauacagaaauuggucaaagccgcaauguaacauuacaggauuugcaccuuuuucuaaggacaauucgauucggcuuuccgcugguggggacaucuggguaacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucgaucucaugccuauauaa

SEQ ID NO: 45347 - RNA, 1410 nt, Artificial Sequence; identical to SEQ ID NO: 45330
  neuraminidase__InfluenzaA__ABD61373

SEQ ID NO: 45348 - RNA, 1410 nt, Artificial Sequence
  neuraminidase__InfluenzaA__ABD61384
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauauaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45349 - RNA, 1410 nt, Artificial Sequence; identical to SEQ ID NO: 45299
  neuraminidase__InfluenzaA__ABD61395

SEQ ID NO: 45350 - RNA, 1410 nt, Artificial Sequence; identical to SEQ ID NO: 45331
  neuraminidase__InfluenzaA__ABD61406

SEQ ID NO: 45351 - RNA, 1413 nt, Artificial Sequence
  neuraminidase__InfluenzaA__ABD61521
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggauccaaaggagauguuuuugucauaagagaaccuuucauaucauguucucacuuggaaugcagaaccuucuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 45352 - RNA, 1410 nt, Artificial Sequence
  neuraminidase__InfluenzaA__ABD61532
augaauccaaaucaaaagauaauaacaauuggcucuguuucucucaccauugcaacaauaugcuuccuuaugcaaauugccauccugguaacuacuguaacauugcauuucaagcaauaugagugcagcucccccccaaacaaccaaguaaugccgugugaaccaauaauaauagaaagaaacauaacagagauaguguauuugacuaacaccaccauagagaaagagauaugccccaaacuaguggaauacagaaauuggucaaagccgcaauguaaaauuacaggauuugcaccuuuuucuaaggacaauucaauucggcuuuccgcugguggggacauuugggugacgagagaaccuuaugugucaugcgauccuggcaaguguuaucaauuugcacucgggcagggaaccacacuaaacaacaagcauucaaaugacacaauacaugauaggaccccuuaucgaacccuauugaugaaugaguuggguguuccauuucauuugggaaccaagcaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggaguguuccuguuauccucgauauccuggugucagaugugucugcagagacaacuggaaaggcuccaauaggcccaucguagauauaaaugugaaagauuauagcauuguuuccaguuaugugugcucagggcuuguuggcgacacacccagaaaaaacgacagauccagcaguagcuauugccggaauccuaacaaugagaaagggaaucauggagugaaaggcugggccuuugacgauggaaaugacguguggaugggaagaacgauuggcgaggaguuacgcucagguuaugaaaccuucaaagucauuggugguugguccacaccuaacuccaaauugcagauaaauaggcaagucauaguugacagcgagaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcaccucagguacauauggaacaggcucauggccugauggagcggacaucagucucaugccuauauaa

SEQ ID NO: 45353 - RNA, 1413 nt, Artificial Sequence
  neuraminidase__InfluenzaA__ABD61543
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaauuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 45354 - RNA, 1413 nt, Artificial Sequence; identical to SEQ ID NO: 45332
  neuraminidase__InfluenzaA__ABD63066

SEQ ID NO: 45355 - RNA, 1410 nt, Artificial Sequence
  neuraminidase__InfluenzaA__ABD77601
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauucuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagaggcaauagguccgguuauucugguauuuucucuguugaaggcaaaagcugcaucaaucggugcuuuuauguggaguugauaaggggaaggaaacaggaaaccgaagucuuguggaccucaaacaguauuguuguguuuuguggcaccucagguacauauggaacaggcucauggccugauggggcggacaucaaucucaugccuauauaa

SEQ ID NO: 45356 - RNA, 1410 nt, Artificial Sequence
  neuraminidase__InfluenzaA__ABD77612
augaauccaaaucaaaagauaauaacgauuggcucuguuucacucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaaugugccccaaacuagcagaauacagaaauugguuaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaauuggguguuccauuucauuugggaaccaagcaagugugcauagcaugguccagcucaaguugucacgauggaaaagcauggcugcauguuuguguaacgggggaugaugaaaaugcaacugcuagcaucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauuaaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaagcuaacuccaaauugcagauaaacaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45357 - RNA, 1410 nt, Artificial Sequence
  neuraminidase__InfluenzaA__ABD77634
augaauccaaaucaaaagauaauaacgauuggcucuguuucacucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaaugugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaauuggguguuccauuucauuugggaaccaagcaagugugcauagcaugguccagcucaaguugucacgauggaaaagcauggcugcauguuuguguaacgggggaugaugaaaaugcaacugcuagcaucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauuaaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaagcuaacuccaaauugcagauaaacaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45358 - RNA, 1410 nt, Artificial Sequence; identical to SEQ ID NO: 45357
  neuraminidase__InfluenzaA__ABD77645

SEQ ID NO: 45359 - RNA, 1410 nt, Artificial Sequence
  neuraminidase__InfluenzaA__ABD77656
augaauccaaaucaaaagauaauaacgauuggcucuguuucacucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaaugugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcaucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauuaaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaagcuaacuccaaauugcagauaaacaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45360 - RNA, 1410 nt, Artificial Sequence
  neuraminidase__InfluenzaA__ABD77700
augaauccaaaucaaaagauaauaacgauuggcucuguuucucucacuauugccacaauaugcuuccuuaugcaaauugccauccugguaacuacuguaacacugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagcccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauugaaggaugguccaaaccuaacuccaaauugcagauaaauaggcaagucauaguugacagagguaauagguccgguuauucugguauuuuuucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45361 - RNA, 1413 nt, Artificial Sequence; identical to SEQ ID NO: 45332
  neuraminidase__InfluenzaA__ABD77722

SEQ ID NO: 45362 - RNA, 1413 nt, Artificial Sequence; identical to SEQ ID NO: 45332
  neuraminidase__InfluenzaA__ABD77733

SEQ ID NO: 45363 - RNA, 1410 nt, Artificial Sequence
  neuraminidase__InfluenzaA__ABD77744
augaauccaaaucaaaagauaauaacgauuggcucuguuucucucaccauugccacaauaugcuuccuuaugcaaauugucauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacuggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggugaugaugaaaaugcaacugcuagcuucauuuacaaugggaggcuuguagauaguauagguucaugguccaaaaaaauccucaggacccaggagucggaaugcguuuguaucaauggaacuuguacaguaguaaugacugauggaagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45364 - RNA, 1410 nt, Artificial Sequence; identical to SEQ ID NO: 45359
  neuraminidase__InfluenzaA__ABD77755

SEQ ID NO: 45365 - RNA, 1410 nt, Artificial Sequence; identical to SEQ ID NO: 45357
  neuraminidase__InfluenzaA__ABD77766

SEQ ID NO: 45366 - RNA, 1410 nt, Artificial Sequence
  neuraminidase__InfluenzaA__ABD77777
augaauccaaaucaaaagauaauaacgauuggcucuguuucucucaccauugccacaauaugcuuccuuaugcaaauugucauccugguaacuacuguaacauugcauuucaagcaauaugaaugcaacucccccccaaacaaccaagugaugccgugugaaccaacaauaauagaaagaaacauaacagagauaguguaucugaccaacaccaccauagagaaggaaauaugccccaaacuagcagaauacagaaauuggucaaagccgcaauguaacauuacuggauuugcaccuuuuucuaaagacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggugaugaugaaaaugcaacugcuagcuucauuuacaaugggaggcuuguagauaguauagguucaugguccaaaaaaauccucaggacccaggagucggaaugcguuuguaucaauggaacuuguacaguaguaaugacugauggaagugcuucaggaaaagcugauacuaaaauacuauucauugaggaggggaaaaucguucauacuagccuauugucagggagugcucagcaugucgaggagugcuccuguuauccucgguauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45367 - RNA, 1410 nt, Artificial Sequence
  neuraminidase__InfluenzaA__ABD77788
augaauccaaaucaaaagauaauaacgauuggcucuguuucucucaccauugccacaauaugcuuccuuaugcaaauugucauccugguaacuacuguaacauugcauuucaagcaauaugaaugcaacucccccccaaacaaccaagugaugccgugugaaccaacaauaauagaaagaaacauaacagagauaguguaucugaccaacaccaccauagagaaggaaauaugccccaaacuagcagaauacagaaauuggucaaagccgcaauguaacauuacuggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggugaugaugaaaaugcaacugcuagcuucauuuacaaugggaggcuuguagauaguauagguucaugguccaaaaaaauccucaggacccaggagucggaaugcguuuguaucaauggaacuuguacaguaguaaugacugauggaagugcuucaggaaaagcugauacuaaaauacuauucauugaggaggggaaaaucguucauacuagccuauugucagggagugcucagcaugucgaggagugcuccuguuauccucgguauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45368 - RNA, 1362 nt, Artificial Sequence
  neuraminidase__InfluenzaA__ABD77799
augaauccaaaccagaaaauaauaaccauugggucaaucuguaugguagucggaauaauuagccuaauauugcaaauagggaauauaaucucaauauggauuagccauucaauucaaaccggaaaucaaaaccauacuggaauaugcaaccaaggcaucauuaccuauaacguuguugcugggcaggacucaacuucagugauauuaaccggcaauucaucucuuugucccauccgugggugggcuauacacagcaaagacaauggcauaagaauugguuccaaaggagacguuuuugucauaagagagccuuuuauuucauguucucacuuggaaugcaggaccuuuuuucugacucaaggcgccuuacugaaugacaagcauucaaaugggaccguuaaggacagaagcccuuauagggccuuaaugagcugcccugucggugaagcuccguccccguacaauucaagguuugaaucgguugcuuggucagcaagugcaugucaugauggcaugggcuggcuaacaaucggaauuucugguccagauaauggagcaguggcuguauuaaaauacaacggcauaauaacugaaaccauaaaaaguuggaggaagaaaauauugagaacacaagagucugaauguaccuguguaaaugguucauguuuuaccauaaugaccgauggcccaaguaaugggcuggccucguacaaaauuuucaagaucgagaaggggaagguuacuaaaucaauagaguugaaugcaccuaauucucacuacgaggaauguuccuguuacccugauaccggcaaagugaugugugugugcagagacaauuggcacgguucgaaccgaccauggguguccuucgaccaaaaccuagauuaucaaauaggauacaucugcagugggguuuucggugacaacccgcgucccaaagauggaacaggcagcuguggcccagugucugcugauggagcaaacggaguaaagggauuuucauauagguaugguaaugguguuuggauaggaaggacuaaaagugacaguuccagacauggguuugagaugauuugggauccuaauggauggacagagacugauaguagguucucugugagacaagauguuguggcaaugacugaucggucaggguacagcggaaguuucguucaacauccugagcuaacagggcuagacuguaugaggccuugcuucuggguugaauuaaucaggggacgaccugaggaggaaacaaucuggacuagugggagcaucauuucuuuuuguggcgugaauagugauacuguagauuggucuuggccagacggugcugaguugccguucaccauugacaaguag

SEQ ID NO: 45369 - RNA, 1410 nt, Artificial Sequence
  neuraminidase__InfluenzaA__ABD77810
augaauccaaaucagaaaauaauaaccauuggaucaaucuguaugguagucggaauaauuagccuaauauugcaaauagggaauauugucucaauauggauuagccauucaauucaaacuggaaaucaaaaccauacuggaacuugcaaccaaagcaucauuaccuauaaaaauagcaccuggguaaaucaaacauaugucaauauuagcaacacuaacguuguugcugggaaggauacaacuucagugauauuagccggcaauucaucucuuugcccuauccgugggugggcuauauacagcaaagauaauggcguaagaauugguuccaaaggagauguuuuugucauaagagaacccuuuauuucauguucucacuuggaaugcaggaccuuuuuucugacccaaggcgcccuguugaaugacaagcauucaaaugggaccguuaaggacagaagcccuuauagggccuuaaugagcugcccuguuggugaagcuccguccccguacaacucaagguuugaaucgguugcuuggucagcaagugcaugucaugauggcaugggcuggcuaacaaucggaauuucugguccagaugauggagcaguggcuguguuaaaauacaacggcauaauaacugaaaccauaaaaaguuggaggaaggaaauauugagaacacaagagucugaaugugucugcguaaaugguucauguuucacuauaaugaccgacggcccgaguggugggccggccucguacaaaauuuucaagaucgagaaggggaagguuacuaaaucaauagaguuggaugcaccuaauucucacuacgaggaauguuccuguuacccugauaccagcaaagugaugugugugugcagagacaauuggcacgguucgaaccgaccaugggugucuuucgaucaaaaucuggauuaucaaaugggauacaucugcagugggguuuucggugacaauccgcgucccaaagauggaaaaggcagcugugguccaguguauguugauggagcaaacggaguaaagggauuuucauacagguaugguaaugguguuuggauagggaggacuaaaaguaacaguuccagacagggguucgagaugauuugggauccuaauggguggacagagacugauaguaauuucuuuacgaaacaagauguaguggcaguaaccgauuggucaggguacagcggaaguuucguucaacauccugagcuaacagggcuggacuguaugaggccuugcuucuggguugaauuaaucaggggacgaccuaaagaaaauacaaucuggaccagugggagcagcauuucuuuuuguggugugaauagugauacuguagauuggucuuggccagacggugccgaguugccauucaccauugacaaguag

SEQ ID NO: 45370 - RNA, 1410 nt, Artificial Sequence
  neuraminidase__InfluenzaA__ABD77832
augaauccaaaucaaaagauaauaacuauuggcucuguuucucucacuauugccacaauaugcuuccuuaugcaaauugccauccugguaacuacuguaacauuacauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugugauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacggugggaggcuuguagauaguauugguucaugguccaaaaaaauccucaggacccaggagucggaaugcguuuguaucaauggaacuuguacaguaguaaugacugauggaagugcuuccggaagagcugauacuaaaauacuauucauugaagaggggaaaaucguucauauuaguccauugucaggaagugcucagcaugucgaggagugcuccuguuauccucgauauucuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuucgcucagguuaugaaaccuucaaagucauuggaggcugguccaaaccuaacuccaaauugcagauaaauaggcaagucauaguugacagaggcaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45371 - RNA, 1410 nt, Artificial Sequence
  neuraminidase__InfluenzaA__ABD77876
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagcccauugucaggaagugcucagcaugucgaggagugcuccuguuauccucgauacucuggugucagaugugucugcagagacaacuggaaaggcuccaauaggcccaucguagauauaaauguaaaggauuauagcauuguuuccaguuaugugugcucaggacuugucggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcacaucagguacauauggaacaggcucauggccugauggggcggacaucaaucucaugccuauauaa

SEQ ID NO: 45372 - RNA, 1410 nt, Artificial Sequence
  neuraminidase__InfluenzaA__ABD77887
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagcccauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuugucggagacacacccagaaaaaacgacagcuccagcaguagccauugccugaauccuaacaaugaggaagggggucauggaguaaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucgaugcuuuuauguggaguugauaaggggaaggaaacaggaaacugaagucugguggaccucaaacaguauuguuguguuuuguggcacaucagguacauauggaacaggcucauggccugauggggcggacaucaaucucaugccuauauaa

SEQ ID NO: 45373 - RNA, 1410 nt, Artificial Sequence
  neuraminidase__InfluenzaA__ABD77898
augaauccaaaucaaaagauaauaacgauuggcucuguuucucucacuauugcuacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucagaaugcguuuguaucaauggaacuuguacaguaguaaugacugaugggagugcuucaggaagagcugauacuaaaauacuauucauugaggaggggaaaaucauucauauuagcccauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuugucggagacacacccagaaaaaacgacagcuccagcaguagccauugccugaauccuaacaaugaggaagggggucauggagugaaaggcugggccuuugaugauggaagugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcacaucagguacauauggaacaggcucauggccugauggggcggacaucaaucucaugccuauauaa

SEQ ID NO: 45374 - RNA, 1410 nt, Artificial Sequence
  neuraminidase__InfluenzaA__ABD77909
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagcccauugucaggaagugcucagcaugucgaggagugcuccuguuauccucgauacccuggugucagaugugucugcagagacaacuggaaaggcuccaacaggcccaucguagauauaaauguaaaggauuauagcauuguuuccaguuaugugugcucaggacuugucggagacacacccagaaaaaacgacagcuccagcaguagccauugccugaauccuaacaaugaggaagggggucauggaguaaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauaguuccgguuauucugguauuuucucuguugaaggcaaaagcugcaucaaucgaugcuuuuauguggaguugauaaggggaaggaaacaggaaacugaagucugguggaccucaaacaguauuguuguguuuuguggcacaucagguacauauggaacaggcucauggccugauggggcggacaucaaucucaugccuauauaa

SEQ ID NO: 45375 - RNA, 1413 nt, Artificial Sequence; identical to SEQ ID NO: 45332
  neuraminidase__InfluenzaA__ABD77920

SEQ ID NO: 45376 - RNA, 1413 nt, Artificial Sequence; identical to SEQ ID NO: 45332
  neuraminidase__InfluenzaA__ABD77931

SEQ ID NO: 45377 - RNA, 1413 nt, Artificial Sequence
  neuraminidase__InfluenzaA__ABD77942
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggauccaaaggagauguuuuugucauaagagaaccuuucauaucauguucucacuuggaaugcagaaccuucuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucacuauugacaaguag

SEQ ID NO: 45378 - RNA, 1413 nt, Artificial Sequence
  neuraminidase__InfluenzaA__ABD77953
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggauccaaaggagauguuuuugucauaagagaaccuuucauaucauguucucacuuggaaugcagaaccuucuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaguuucguucaacauccugaguuaacaggauuggacuguauaagaccuugcuucuugguugaguuagucagaggacugccuagagaaaauacaacaaucuggacuagugggagcagcauuucuuuuuguggcguaaauagugauacugcaaacuggucuuggccagacggugcugaguugccguucaccauugacaaguaa

SEQ ID NO: 45379 - RNA, 1413 nt, Artificial Sequence
  neuraminidase__InfluenzaA__ABD77964
augaauccaaaucaaaaaauaauaaccauuggaucaaucaguauagcaaucggaauaauuagucuaauguugcaaauaggaaauauuauuucaauaugggcuagucacucaauccaaacuagaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 45380 - RNA, 1413 nt, Artificial Sequence
  neuraminidase__InfluenzaA__ABD77975
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguuccaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 45381 - RNA, 1413 nt, Artificial Sequence
  neuraminidase__InfluenzaA__ABD77986
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguuccaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 45382 - RNA, 1413 nt, Artificial Sequence
  neuraminidase__InfluenzaA__ABD77997
augaauccaaaucaaaaaauaauaaccauuggaucaaucaguauagcaaucggaauacuuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguuccaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaauaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 45383 - RNA, 1413 nt, Artificial Sequence
  neuraminidase__InfluenzaA__ABD78008
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguuccaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaauuuggacuagugggagcagcauuucuuuuuguggcguaaauagugauacugcaaacuggucuuggccagacggugcugaguugccguucaccauugacaaguag

SEQ ID NO: 45384 - RNA, 1413 nt, Artificial Sequence; identical to SEQ ID NO: 45332
  neuraminidase__InfluenzaA__ABD78019

SEQ ID NO: 45385 - RNA, 1413 nt, Artificial Sequence
  neuraminidase__InfluenzaA__ABD78030
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaauaggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaauggcauaauaacugaaaccauaaaaaguuggaaaaagcgaauauuaagaacacaagagucugaaugugucugugugaacgggucauguuucaccauaaugaccgauggcccgaauaauggggccgccucguacaaaaucuucaagaucgaaaaggggaagguuacuaaaucaauagaguugaaugcacccaauuuccauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 45386 - RNA, 1413 nt, Artificial Sequence
  neuraminidase__InfluenzaA__ABD78041
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuagcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 45387 - RNA, 1410 nt, Artificial Sequence; identical to SEQ ID NO: 45367
  neuraminidase__InfluenzaA__ABD78052

SEQ ID NO: 45388 - RNA, 1413 nt, Artificial Sequence
  neuraminidase__InfluenzaA__ABD78063
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacgguauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaguguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45389 - RNA, 1413 nt, Artificial Sequence
  neuraminidase__InfluenzaA__ABD78074
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45390 - RNA, 1413 nt, Artificial Sequence; identical to SEQ ID NO: 45389
  neuraminidase__InfluenzaA__ABD78085

SEQ ID NO: 45391 - RNA, 1413 nt, Artificial Sequence; identical to SEQ ID NO: 45389
  neuraminidase__InfluenzaA__ABD78096

SEQ ID NO: 45392 - RNA, 1410 nt, Artificial Sequence
  neuraminidase__InfluenzaA__ABD78118
augaauccaaaucaaaagauaauaacuauuggcucuguuucucucacuauugccacaauaugcuuccuuaugcaaauugccauccugguaacuacuguaacauuacauuucaagcaauaugaaugcaacucccccccaaacaaccaaguaaugcugugugaaccaacaauaauagaaagaaacauaacagagauaguguaucugaccaacaccaccauagagaaggaaaugugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugugauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugauggaagugcuuccggaagagcugauacuaaaauacuauucauugaagaggggaaaaucguucauauuaguccauugucaggaagugcucagcaugucgaggagugcuccuguuauccucgauauucuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuucgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45393 - RNA, 1410 nt, Artificial Sequence; identical to SEQ ID NO: 45392
  neuraminidase__InfluenzaA__ABD78129

SEQ ID NO: 45394 - RNA, 1410 nt, Artificial Sequence; identical to SEQ ID NO: 44837
  neuraminidase__InfluenzaA__ABD79035

SEQ ID NO: 45395 - RNA, 1353 nt, Artificial Sequence
  neuraminidase__InfluenzaA__ABD79115
augaauccaaaucagaaaauaauaaccauuggaucaaucuguaugguagucggaauaauuagccuaauauuucaaauagggaauauugucucaauauggauuagccauucaauuacuggaacuugcaaccgaagcaucuaugucaauauuagcaacacuaacguuguugcugggaaggauacaacuucagugauauuagccggcaauucaucucuuugcccuauccguggaugggcuauauacagcaaagauaauggcguaagaauugguuccaaaggagauguuuuugucauaagagaacccuuuauuucauguucucacuuggaaugcaggaccuuuuuucugacccaaggcgcccuguugaaugacaagcauucaaaugggaccguuaaggacagaagcccuuauaggaccuuaaugagcugcccuguuggugaagcuccguccccguacaauucaagguuugaaucgguugcuuggucagcaagugcaugucaugauggcaugggcuggcuaacaaucggaauuucugguccagaugauggagcaguggcuguguuaaaauacaacggcauaauaacuggaaccauaaaaaguuggaggaaggaaauauugagaacacaagagucugaaugugucugcguaaaugguucauguuucacuauaaugaccgacggcccgaguggugggccggccucguacaaaaucuucaagauugagaaggggaagguuacuaaaucaauagaguuggaugcaccuaauucucacuacgaggaauguuccugcuacccugauaccagcaaggugaugugugugugcagagacaauuggcacgguucgaaccgaccaugggugucuuucgaucaaaaucuggauuaucaaaugggauacaucugcagugggguuuucggugacaauccgcgucccaaagauggaaaaggcagcugugguccaguguauguugauggagcaaacggaguaaagggauuuucauacagguaugguaaugguguuuggauaggaaggacuaaaaguagcaguuccagacagggguuugagaugauuugggauccuaauggguggacagagacugauaguaauuucuuuaugaaacaagauguaguggcaguaaccgauuggucaggguacagcggaaguuucguucaacauccugagcuaacagggcuggacuguaugaggccuugcuucuggguugaauuaaucaggggacgaccuaaagaaaauacaaucuggaccagugggagcagcauuucuuuuuguggugugaauagugauacuguagauuggucuuggccagacggugcugaguugccauucaccauugacaaguag

SEQ ID NO: 45396 - RNA, 1410 nt, Artificial Sequence
  neuraminidase__InfluenzaA__ABD79126
augaauccaaaucaaaagauaauaacaauuggcucuguuucucucacuauuaccacaauaugcuuccuuaugcaaauugccauccugguaauuacuguaacauugcauuucaagcaaugugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacacgauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcgaguuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccuggauccuaacaaugaggaagggggucauggagugaaaggcugggccuuugaugauggaaaugauguguggaugggaagaacgaucagugagaaguuacguucagguuaugaaaccuucaaagucauuggaggcugguccaagccuaacuccaaauugcagauaaauaggcaagucauaguugacaaagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45397 - RNA, 1410 nt, Artificial Sequence
  neuraminidase__InfluenzaA__ABD79137
augaauccaaaucaaaagauaauaacaauuggcucuguuucucucacuauuaccacaauaugcuuccuuaugcaaauugccauccugguaauuacuguaacauugcauuucaagcaaugugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacacgauaggaccccuuaucgaacccuauugaugaaugaguuggguguuccauuucauuugggaaccaagcaaguaugcauagcaugguccagcucaaguugucacgauggaaaagcauggcugcauguuuguguaacugggcauaaugaaaaugcaacugcgaguuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccuggauccuaacaaugaggaagggggucauggagugaaaggcugggccuuugaugauggaaaugauguguggaugggaagaacgaucagugagaaguuacgcucagguuaugaaaccuucaaagucauuggaggcugguccaagccuaacuccaaauugcagauaaauaggcaagucauaguugacaaagguaauagguccgguuauucugguauuuucucuguggaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45398 - RNA, 1410 nt, Artificial Sequence
  neuraminidase__InfluenzaA__ABD79148
augaauccaaaucaaaagauaauaacaauuggcucuguuucucucacuauuaccacaauaugcuuccuuaugcaaauugccauccugguaauuacuguaacauugcauuucaagcaaugugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacacgauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcgaguuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccuggauccuaacaaugaggaagggggucauggagugaaaggcugggccuuugaugauggaaaugauguguggaugggaagaacgaucagugagaaguuacgcucagguuaugaaaccuucaaagucauuggaggcugguccaagccuaacuccaaauugcagauaaauaggcaagucauaguugacaaagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45399 - RNA, 1410 nt, Artificial Sequence; identical to SEQ ID NO: 45398
  neuraminidase__InfluenzaA__ABD79159

SEQ ID NO: 45400 - RNA, 1410 nt, Artificial Sequence
  neuraminidase__InfluenzaA__ABD79170
augaauccaaaucaaaagauaauaacaauuggcucuguuucucucacuauuaccacaauaugcuuccuuaugcaaauugccauccugguaauuacuguaacauugcauuucaagcaaugugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaauaacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcgaguuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauuaaagaggggaaaaucguucauguuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccaggaaaaacgacagcuccagcaguagcuauugccuggauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacaaagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45401 - RNA, 1410 nt, Artificial Sequence
  neuraminidase__InfluenzaA__ABD79181
augaauccaaaucaaaagauaauaacaauuggcucuguuucucucacuauuaccacaauaugcuuccuuaugcaaauugccauccugguaauuacuguaacauugcauuucaagcaaugugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacacgauaggaccccuuaucgaacccuauugaugaaugaguuggguguuccauuucauuugggaaccaagcaaguaugcauagcaugguccagcucaaguugucacgauggaaaagcauggcugcauguuuguguaacugggcauaaugaaaaugcaacugcgaguuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccuggauccuaacaaugaggaagggggucauggagugaaaggcugggccuuugaugauggaaaugauguguggaugggaagaacgaucagugagaaguuacgcucagguuaugaaaccuucaaagucauuggaggcugguccaagccuaacuccaaauugcagauaaauaggcaagucauaguugacaaagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45402 - RNA, 1410 nt, Artificial Sequence; identical to SEQ ID NO: 45398
  neuraminidase__InfluenzaA__ABD79192

SEQ ID NO: 45403 - RNA, 1410 nt, Artificial Sequence
  neuraminidase__InfluenzaA__ABD79203
augaauccaaaucaaaagauaauaacaauuggcucuguuucucucacuauuaccacaauaugcuuccuuaugcaaauugccauccugguaauuacuguaacauugcauuucaagcaaugugaaugcaacucccccccaaacaaccaaguaaugcugugugaaccaacaauaauagaaagaaacauaacagagauaguguaucugaccaacaccaccauagagaaagaaaaaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacacgauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcgaguuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaauaugaaagauuauagcauuguuuccaguuaugugugcucaggacuuguuggagacacacccagaaaaaacgacagcuccagcaguagcuauugccuggauccuaacaaugaggaagggggucauggagugaaaggcugggccuuugaugauggaaaugauguguggaugggaagaacgaucagugagaaguuacgcucagguuaugaaaccuucaaagucauuggaggcugguccaagccuaacuccaaauugcagauaaauaggcaagucauaguugacaaagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauaugggacaggcucauggccugauggggcggacaucaaucucaugccuauauaa

SEQ ID NO: 45404 - RNA, 1410 nt, Artificial Sequence
  neuraminidase__InfluenzaA__ABD79214
augaauccaaaucaaaagauaauaacaauuggcucuguuucucucacuauuaccacaauaugcuuccuuaugcaaauugccauccugguaauuacuguaacauugcauuucaagcaaugugaaugcaacucccccccaaacaaccaaguaaugcugugugaaccaacaauaauagaaagaaacauaacagagauaguauaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacacgauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcgaguuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaagagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccuggauccuaacaaugaggaagggggucauggagugaaaggcugggccuuugaugauggaaaugauguguggaugggaagaacgaucagugagaaguuacgcucagguuaugaaaccuucaaagucauuggaggcugguccaagccuaacuccaaauugcagauaaauaggcaagucauaguugacaaagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45405 - RNA, 1410 nt, Artificial Sequence
  neuraminidase__InfluenzaA__ABD79236
augaauccaaaucaaaagauaauaacaauuggcucuguuucucucacuauuaccacaauaugcuuccuuaugcaaauugccauccugguaauuacuguaacauugcauuucaagcaaugugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaauaacacagcacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcgaguuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauuaaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccaggaaaaacgacagcuccagcaguagcuauugccuggauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacaaagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45406 - RNA, 1410 nt, Artificial Sequence
  neuraminidase__InfluenzaA__ABD79247
augaauccaaaucaaaagauaauaacaauuggcucuguuucucucacuauuaccacaauaugcuuccuuaugcaaauugccauccugguaauuacuguaacauugcauuucaagcaaugugaaugcaacccccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcgagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauaucagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccuggauccuaacaaugaggaagggggucauggagugaaaggcugggcauuugaugauggaaaugauguguggaugggaagaacgaucagcgagaaguuacgcucagguuaugaaaccuucaaagucaugggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45407 - RNA, 1410 nt, Artificial Sequence; identical to SEQ ID NO: 44870
  neuraminidase__InfluenzaA__ABD94737

SEQ ID NO: 45408 - RNA, 1410 nt, Artificial Sequence; identical to SEQ ID NO: 45232
  neuraminidase__InfluenzaA__ABD94748

SEQ ID NO: 45409 - RNA, 1413 nt, Artificial Sequence; identical to SEQ ID NO: 45332
  neuraminidase__InfluenzaA__ABD94759

SEQ ID NO: 45410 - RNA, 1410 nt, Artificial Sequence
  neuraminidase__InfluenzaA__ABD94770
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacuggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggugaugaugaaaaugcaacugcuagcuucauuuacaaugggaggcuuguagauaguauagguucaugguccaaaaaaauccucaggacccaggagucggaaugcguuuguaucaauggaacuuguacaguaguaaugacugauggaagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45411 - RNA, 1413 nt, Artificial Sequence; identical to SEQ ID NO: 45389
  neuraminidase__InfluenzaA__ABD94792

SEQ ID NO: 45412 - RNA, 1413 nt, Artificial Sequence; identical to SEQ ID NO: 45389
  neuraminidase__InfluenzaA__ABD94803

SEQ ID NO: 45413 - RNA, 1413 nt, Artificial Sequence; identical to SEQ ID NO: 45389
  neuraminidase__InfluenzaA__ABD94814

SEQ ID NO: 45414 - RNA, 1410 nt, Artificial Sequence
  neuraminidase__InfluenzaA__ABD94825
augaauccaaaucaaaagauaauaacgauuggcucuguuucucucacuauugccacaauaugcuuccuuaugcaaauugccauccugguaacuacuguaacauugcauuucaagcaauaugaaugcagcucucccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagggagccuuaugugucgugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauaucagcccacugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagucauugccugaauccuaacaaugaggaagggggucauggagugaaaggcugggccuuugaugauggaaaugacguguggaugggaagaacgaucagcgagaaguuccgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45415 - RNA, 1410 nt, Artificial Sequence
  neuraminidase__InfluenzaA__ABD94847
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaaaaauaauagaaagaaacauaacagagauaguguaucugacaaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcuguuacuaaaauacuauucauugaagaggggaaaaucguucauauuagcccauuguuaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45416 - RNA, 1410 nt, Artificial Sequence
  neuraminidase__InfluenzaA__ABD94858
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagcccauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuugucggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcacaucagguacauauggaacaggcucauggccugauggggcggacaucaaucucaugccuauauaa

SEQ ID NO: 45417 - RNA, 1410 nt, Artificial Sequence
  neuraminidase__InfluenzaA__ABD94880
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagcccauugucagggagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuugucggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcacaucagguacauauggaacaggcucauggccugauggggcggacaucaaucucaugccuauauaa

SEQ ID NO: 45418 - RNA, 1410 nt, Artificial Sequence
  neuraminidase__InfluenzaA__ABD94891
augaauccaaaucaaaagauaauaacaauuggcucuguuucucucacuauuaccacaauaugcuuccuuaugcaaauugccauccugguaauuacuguaacauugcauuucaagcaaugugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaacucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcgagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaguacuauucauugaagaggggaaaaucguucauauuagccaauugucaggaagugcucagcaugucgaggagugcuccuguuauccucgauauccuggugucagaugugucugcagagacaacuggaaaggcucuaauaggcccaucguagauauaaaugugaaagauuauagcauuguuuccaguuauguaugcucaggacuuguuggagacacacccagaaaaaacgacagcuccagcaguagcuauugccuggauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45419 - RNA, 1410 nt, Artificial Sequence; identical to SEQ ID NO: 45398
  neuraminidase__InfluenzaA__ABD94902

SEQ ID NO: 45420 - RNA, 1410 nt, Artificial Sequence
  neuraminidase__InfluenzaA__ABD94924
augaauccaaaucaaaagauaauaacgauuggcucuguuucucucacuauugccacaauaugccuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauuccauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaggugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaagggaaaaucguucauauuagccaauuguuaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45421 - RNA, 1410 nt, Artificial Sequence
  neuraminidase__InfluenzaA__ABD94946
augaauccaaaucaaaaaauaauaacgauuggcucuguuucucucaccauugccacaauaugcuuccuuacgcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuggcagaauacagaaauuggucaaagccgcaaugcaacauuacuggauuugcaccuuuuucuaaggacaauucgauucggcuuuccgcugguggggacaucuggguuacaagagaaccuuaugugucaugcgauccugacaaauguuaucaauuugcccuuggacagggaacaacacuaaacaacgggcauucaaaugacacaguacaugauaggaccccuuauaggacccuauugaugaaugaguuggguguuccauuucauuugggaaccaagcaagugugcauagcaugguccagcucaaguugucacgauggaaaagcauggcugcauguuuguguaacgggggaugauaaaaaugcaacugcuagcuucauuuacaaugggaggcuuguagauaguauagguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagauccagcaguagccauugcuuggauccuaacaaugaggaagguggucauggaguaaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagauaauagguccgguuauucugguauuuucucuguugaaggcaaaagcugcaucaaucggugcuuuuauguggaguugauaaggggaaggaaccaggaaacugaagucuuguggaccucaaacaguauuguuguguuuuguggcaccucagguacauauggaacaggcucauggccugauggggcggacaucaaucucaugccuauauaa

SEQ ID NO: 45422 - RNA, 1410 nt, Artificial Sequence
  neuraminidase__InfluenzaA__ABD94957
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaagcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45423 - RNA, 1413 nt, Artificial Sequence
  neuraminidase__InfluenzaA__ABD94968
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaagaacuaaaaguaacagacuuagaaagggguuugagaugauuugggauccuaauggauggacagauaccgacaguaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 45424 - RNA, 1413 nt, Artificial Sequence; identical to SEQ ID NO: 45332
  neuraminidase__InfluenzaA__ABD94990

SEQ ID NO: 45425 - RNA, 1413 nt, Artificial Sequence
  neuraminidase__InfluenzaA__ABD95001
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauucacaacacuaauguuguugcuggaaaggacaaaacuucagugacauuggccggcaauucaucucuuuguucuaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcugcccucuaggugaagcuccguccccauacaauucaaaauuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucaaugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 45426 - RNA, 1413 nt, Artificial Sequence
  neuraminidase__InfluenzaA__ABD95012
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacaaauaccgacaguaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 45427 - RNA, 1413 nt, Artificial Sequence; identical to SEQ ID NO: 45381
  neuraminidase__InfluenzaA__ABD95023

SEQ ID NO: 45428 - RNA, 1413 nt, Artificial Sequence
  neuraminidase__InfluenzaA__ABD95034
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaguuucauucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 45429 - RNA, 1413 nt, Artificial Sequence
  neuraminidase__InfluenzaA__ABD95056
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagauuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauugaacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45430 - RNA, 1413 nt, Artificial Sequence; identical to SEQ ID NO: 45389
  neuraminidase__InfluenzaA__ABD95067

SEQ ID NO: 45431 - RNA, 1413 nt, Artificial Sequence; identical to SEQ ID NO: 45389
  neuraminidase__InfluenzaA__ABD95078

SEQ ID NO: 45432 - RNA, 1413 nt, Artificial Sequence; identical to SEQ ID NO: 45429
  neuraminidase__InfluenzaA__ABD95089

SEQ ID NO: 45433 - RNA, 1413 nt, Artificial Sequence; identical to SEQ ID NO: 45389
  neuraminidase__InfluenzaA__ABD95100

SEQ ID NO: 45434 - RNA, 1413 nt, Artificial Sequence
  neuraminidase__InfluenzaA__ABD95111
augaauccaaaucaaaaaauaauaaccauuggaucaaucaguauagcaaucggaaugauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45435 - RNA, 1413 nt, Artificial Sequence; identical to SEQ ID NO: 45434
  neuraminidase__InfluenzaA__ABD95122

SEQ ID NO: 45436 - RNA, 1413 nt, Artificial Sequence; identical to SEQ ID NO: 45389
  neuraminidase__InfluenzaA__ABD95144

SEQ ID NO: 45437 - RNA, 1413 nt, Artificial Sequence; identical to SEQ ID NO: 45389
  neuraminidase__InfluenzaA__ABD95155

SEQ ID NO: 45438 - RNA, 1413 nt, Artificial Sequence
  neuraminidase__InfluenzaA__ABD95166
augaauccaaaucaaaaaauaauaaccauuggaucaaucaguauagcaaucggaaugauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcugaaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucuguguuaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45439 - RNA, 1413 nt, Artificial Sequence; identical to SEQ ID NO: 45429
  neuraminidase__InfluenzaA__ABD95177

SEQ ID NO: 45440 - RNA, 1413 nt, Artificial Sequence
  neuraminidase__InfluenzaA__ABD95188
augaauccaaaucaaaaaauaauaaccauuggaucaaucaguacaacaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45441 - RNA, 1413 nt, Artificial Sequence; identical to SEQ ID NO: 45429
  neuraminidase__InfluenzaA__ABD95199

SEQ ID NO: 45442 - RNA, 1413 nt, Artificial Sequence
  neuraminidase__InfluenzaA__ABD95210
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguuaauagugauacugcaaauuggucuuggccagacggugcugaguugccguucaccauugacaaguag

SEQ ID NO: 45443 - RNA, 1413 nt, Artificial Sequence
  neuraminidase__InfluenzaA__ABD95221
augaauccaaaucaaaaaauaauaaccauuggaucaaucaguauagcaaucggaaugauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauucucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45444 - RNA, 1413 nt, Artificial Sequence; identical to SEQ ID NO: 45434
  neuraminidase__InfluenzaA__ABD95232

SEQ ID NO: 45445 - RNA, 1413 nt, Artificial Sequence
  neuraminidase__InfluenzaA__ABD95243
augaauccaaaucaaaaaauaauaaccauugguucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45446 - RNA, 1413 nt, Artificial Sequence
  neuraminidase__InfluenzaA__ABD95254
augaauccaaaucaaaaaauaauaaccauuggaucaaucaguauagcaaucggaaugauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauugagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45447 - RNA, 1413 nt, Artificial Sequence; identical to SEQ ID NO: 45442
  neuraminidase__InfluenzaA__ABD95265

SEQ ID NO: 45448 - RNA, 1413 nt, Artificial Sequence; identical to SEQ ID NO: 45389
  neuraminidase__InfluenzaA__ABD95276

SEQ ID NO: 45449 - RNA, 1413 nt, Artificial Sequence
  neuraminidase__InfluenzaA__ABD95287
augaauccaaaucaaaaaauaauaaccauuggaucaaucaguguagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacugucgauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacuaccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45450 - RNA, 1413 nt, Artificial Sequence; identical to SEQ ID NO: 45445
  neuraminidase__InfluenzaA__ABD95298

SEQ ID NO: 45451 - RNA, 1413 nt, Artificial Sequence
  neuraminidase__InfluenzaA__ABD95309
augaauccaaaucaaaaaauaauaaccauuggaucaaucaguauagcaaucggaaugauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaauguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45452 - RNA, 1413 nt, Artificial Sequence; identical to SEQ ID NO: 45389
  neuraminidase__InfluenzaA__ABD95320

SEQ ID NO: 45453 - RNA, 1413 nt, Artificial Sequence; identical to SEQ ID NO: 45429
  neuraminidase__InfluenzaA__ABD95331

SEQ ID NO: 45454 - RNA, 1413 nt, Artificial Sequence
  neuraminidase__InfluenzaA__ABD95342
augaauccaaaucagaaaauaauaaccauuggaucaaucuguauggcaaucgggauaauuagucuaauauugcaaauaggaaauauuauuucaauauggguuagccacucaauccaaacuggaagucaaaaccacacuggaauaugcaaccaaagaaucaucaccuaugaaaauagcaccuggguaaaucaaacauauguuaauauuaacaacacuaacguuguugcuggaaaggacacaacuucagugacacuagccggcaauucaucucuuuguccuguccgugggugggcuauauacagcaaagacaacagcauaagaauugguuccaaaggagauguuuuugucauaagagaaccuuuuauaucauguucucacuuggaaugcagaaccuuuuuucuaacccaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcaugggcuggcuaacaaucggaauuucuggaccagaugauggagcaguggcuguacuaaaauacaacggcauaauaacugaaaccauaaaaaguuggaggaaacgaauauuaagaacacaagagucugaaugugucuguauaaacgguucauguuuuaccauaaugaccgauggcccaaguaaugggccggccucguacagaaucuucaaaaucgagaaggggaaaauuacuaaaucaauagaguuggaugcacccaauucucacuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcagcugugguccaguaacuguugauggagcagacggaguaaagggguuuucauacagguaugguaauggugucuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagagggcgaccuagagaaaagacaacaaucuggacuagugggagcagcauuucuuuuuguggcgugaauagugauacuguaaauuggucuuggccagacggugccgaguugccauucaccauugacaaguag

SEQ ID NO: 45455 - RNA, 1413 nt, Artificial Sequence
  neuraminidase__InfluenzaA__ABD95353
augaauccaaaucagaaaauaauaaccauuggaucaaucuguauggcaaucggaauaauuagucuaauauugcaaauagggaauauuaucucaauauggguuagccacucaauucaaacuggaagucaaaaccauacaggaauaugcaaccaaagaaucauuaccuaugaaaauagcaccuggguaaaucaaacauauguuaauauuagcaacacuaacguuguugcuggaaaggacacaacuucaaugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggcgcucuauuaaaugacaagcauucaaaugggaccguuaaggacagaagcccuuauagggccuuaaugagcuguccuauaggugaagcuccgucuccauacaauucaagguuugaaucgguugcuuggucagcaagugcaugucacgauggcaugggcuggcuaacaaucggaauuucugguccagaugauggagcaguggcuguacuaaaauacaacggcauaauaacugaaaccauaaaaaguuggaggaagcaaauauuaagaacacaagagucugaaugugucuguguaaacgguucauguuuuaccauaaugaccgauggcccgagugaugggccggccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcaguugugauccaguaaauguugauggagcagacggaguaaagggguuuucauacagauaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgacccagagaaaaaacaacaaucuggacuagugggagcagcauuucuuuuuguggcgugaauagugauacuguaaauuggucuuggccagacggugccgaguugccauucaccauugacaaguag

SEQ ID NO: 45456 - RNA, 1413 nt, Artificial Sequence; identical to SEQ ID NO: 45332
  neuraminidase__InfluenzaA__ABE11660

SEQ ID NO: 45457 - RNA, 1413 nt, Artificial Sequence
  neuraminidase__InfluenzaA__ABE11671
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaguaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggccuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuaauaaaucaauagaguugaaugcacccaauuuucauuaugaggaauguuccuguuacccagauacuggcacagugauguguguaugcagggacaacuggcaugguucaaaucgaccuugggugucuuuuaaucaaaaccuggauuaucaaauaggauacaucugcagugggguguucggugacaauccccgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 45458 - RNA, 1413 nt, Artificial Sequence
  neuraminidase__InfluenzaA__ABE11682
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguuaauagugauacugcaaacuggucuuggccagacggugcugaguugccguucaccauugacaaguag

SEQ ID NO: 45459 - RNA, 1413 nt, Artificial Sequence; identical to SEQ ID NO: 45389
  neuraminidase__InfluenzaA__ABE11693

SEQ ID NO: 45460 - RNA, 1413 nt, Artificial Sequence
  neuraminidase__InfluenzaA__ABE11704
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucauacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45461 - RNA, 1413 nt, Artificial Sequence; identical to SEQ ID NO: 45389
  neuraminidase__InfluenzaA__ABE11715

SEQ ID NO: 45462 - RNA, 1413 nt, Artificial Sequence; identical to SEQ ID NO: 45429
  neuraminidase__InfluenzaA__ABE11726

SEQ ID NO: 45463 - RNA, 1413 nt, Artificial Sequence
  neuraminidase__InfluenzaA__ABE11737
augaauccaaaucaaaaaauaauaaccauuggaucaaucaguauagcaaucggaaugauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaauuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45464 - RNA, 1413 nt, Artificial Sequence; identical to SEQ ID NO: 45389
  neuraminidase__InfluenzaA__ABE11815

SEQ ID NO: 45465 - RNA, 1413 nt, Artificial Sequence; identical to SEQ ID NO: 45429
  neuraminidase__InfluenzaA__ABE11826

SEQ ID NO: 45466 - RNA, 1413 nt, Artificial Sequence; identical to SEQ ID NO: 45429
  neuraminidase__InfluenzaA__ABE11837

SEQ ID NO: 45467 - RNA, 1413 nt, Artificial Sequence; identical to SEQ ID NO: 45429
  neuraminidase__InfluenzaA__ABE11848

SEQ ID NO: 45468 - RNA, 1413 nt, Artificial Sequence
  neuraminidase__InfluenzaA__ABE11859
augaauccaaaucaaaaaauaauaaccauuggaucaaucaguauagcaaucggaaugauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccugcuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45469 - RNA, 1413 nt, Artificial Sequence
  neuraminidase__InfluenzaA__ABE11903
augaauccaaaucaaaaaauaauaaccauuggaucaaucaguauggcaauaggaauaauuagucuaauauugcaaauaggaaauauuauuucaauaugggcuagccacucaauccaaacuggaagucaaaacuacacuggaauaugcaaccaaagaaucauuacauaugaaaauagcaccuggguaaaucaaacauauguuaauauuaacaacacuaauguuguugcuggaaaggacaaaaccucaaugacauuggccggcaauucaucucuuugccccauccguggaugggcuauauacacaaaagacaacagcauaagaauugguuccaaaggagauguuuuugucauaagagagccuuuuauaucauguucucauuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcuugccaugauggcuugggcuggcuaacaaucggaauuucugguccagauaauggagcaguggcuguacuaaaauacaacggcauaauaacugaaaccauaaaaaguuggaagaagcaaaucuuaagaacacaagagucugaaugugucugugugaacgguucauguuuuaccauaaugaccgauggcccgaguaauggggcugcaucguacagaaucuucaaaaucgagaaggggagaguuacuaaaucaauagaguuggaugcacccaauuaucauuacgaggaauguuccuguuacccagacaccggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggacccuaauggauggacagauaccgacagugauuucucaaugaaacaggaugucguggcaaugacugauuggucaggguacagcggaaguuuuguccaacauccugagcuaacaggauuggacuguaugagaccuugcuucuggguugaauuagucagagggcuaccuagagaaaauacaacaaucuggacuagugggagcagcauuucuuuuuguggcguaaauagcgagacugcaaacuggucuuggccagacggugcugaguugccauucaccauugacaaguag

SEQ ID NO: 45470 - RNA, 1413 nt, Artificial Sequence
  neuraminidase__InfluenzaA__ABE11925
augaauccaaaucaaaaaauaauaaccauuggaucaaucaguauugcaauuggaauaauuagucugauauugcaaauaggaaauauuauuucaauaugggcuagccacucaauccaaacuggaagucaaaaccacacuggaauaugcaaccaaagaaucauuacauaugaaaauagcaccuggguaaaucaaacauauguuaauauuaacaacacuaauguuguugcaggaaaggacaaaaccucaaugacauuggccggcaauucaucucuuugcccuauccguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaauuucugguccagauaacggggcaguggcuguacuaaaauacaacggcauaauaacugaaaccauuaaaaguuggaagaagcgaauauuaagaacacaagagucugaaugugucuguaugaacgguucauguuuuaccauaaugaccgauggcccgaguaauggggccgcaucguacagaaucuucaaaaucgagaaggggaaaguuacuaaaucaauagaguuggaugcacccaauuaucauuacgaggaauguucauguuacccagacaccggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacugcugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugaaacaggauaucguggcaaugacugauuggucaggguacagcggaaguuuuguucaacauccugagcuaacaggauuagacuguaugagaccuugcuucuggguugaauuagucagagggcuaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 45471 - RNA, 1413 nt, Artificial Sequence
  neuraminidase__InfluenzaA__ABE11952
augaauccaaaucaaaaaauaauaaccauuggaucaaucaguauggcaauaggaauaauuagucuaauauugcaaauaggaaauauuauuucaauaugggcuagccacucaauccaaacuggaagucaaaacuacacuggaauaugcaaccaaagaaucauuacauaugaaaauagcaccuggguaaaucaaacauauguuaauauuaacaacacuaauguuguugcuggaaaggacaaaaccucaaugacauuggccggcaauucaucucuuugccccauccguggaugggcuauauacacaaaagacaacagcauaagaauugguuccaaaggagauguuuuugucauaagagagccuuuuauaucauguucucauuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcuugccaugauggcuugggcuggcuaacaaucggaauuucugguccagauaauggagcaguggcuguacuaaaauacaacggcauaauaacugaaaccauaaaaaguuggaagaagcaaaucuuaagaacacaagagucugaaugugucugugugaacgguucauguuuuaccauaaugaccgauggcccgaguaauggggcugcaucguacagaaucuucaaaaucgagaaggggagaguuacuaaaucaauagaguuggaugcacccaauuaucauuacgaggaauguuccuguuacccagacaccggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggacccuaauggauggacagauaccgacagugauuucucaaugaaacaggaugucguggcaaugacugauuggucaggguacagcggaaguuuuguccaacauccugagcuaacaggauuggacuguaugagaccuugcuucuggguugaauuagucagagggcuaccuagagaaaauacaacaaucuggacuagugggagcagcauuucuuuuuguggcguaaauagcgagacugcagacuggucuuggccagacggugcugaguugccauucaccauugacaaguag

SEQ ID NO: 45472 - RNA, 1413 nt, Artificial Sequence
  neuraminidase__InfluenzaA__ABE12035
augaauccaaaucaaaaaauaauaaccauuggaucaaucaguauugcaauuggaauaauuagucugauauugcaaauaggaaauauuauuucaauaugggcuagccacucaauccaaacuggaagucaaaaccacacuggaauaugcaaccaaagaaucauuacauaugaaaauagcaccuggguaaaucaaacauauguuaauauuaacaacacuaauguuguugcuggaaaggacaaaaccucaaugacauuggccggcaauucaucucuuugcccuauccguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaauuucugguccagauaauggggcaguggcuguacuaaaauacaacggcauaauaacugaaaccauuaaaaguuggaagaagcgaauauuaagaacacaagagucugaaugugucuguaugaacgguucauguuuuaccauaaugaccgauggcccgaguaauggggccgcaucguacagaaucuucaaaaucgagaaggggagaguuacuaaaucaauagaguuggaugcacccaauuaucauuacgaggaauguucauguuacccagacaccggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugaaacaggauaucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 45473 - RNA, 1410 nt, Artificial Sequence; identical to SEQ ID NO: 45247
  neuraminidase__InfluenzaA__ABE12094

SEQ ID NO: 45474 - RNA, 1410 nt, Artificial Sequence; identical to SEQ ID NO: 45367
  neuraminidase__InfluenzaA__ABE12126

SEQ ID NO: 45475 - RNA, 1413 nt, Artificial Sequence
  neuraminidase__InfluenzaA__ABE12263
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucgucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45476 - RNA, 1410 nt, Artificial Sequence
  neuraminidase__InfluenzaA__ABE12626
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacaggaaauggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcagggaaccacacuagacaacaaacauucaaaugacacaauacaugauagaaucccucaucgaacccuauugaugaaugaguuggguguuccauuucauuugggaaccaggcaaguguguauagcaugguccagcucaaguugucacgauggaaaagcauggcugcauguuugugucacuggggaugauaaaaaugcaacugcuagcuucauuuacgaugggaggcuuguggacaguauugguucauggucucaaaauauccucaggacccaggagucggaaugcguuuguaucaaugggacuuguacaguaguaaugacugauggaagugcuucaggaagagcugauacuagaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaauagcuauugccggaauccuaacaaugagagagggaaucacggagugaaaggcugggccuuugacgauggaaaugacguguggaugggaagaacgaucagcaaggauucacgcucagguuaugaaaccuucaaagucauuggugguugguccacaccuaauuccaaaucgcagauaaauaggcaagucauaguugacagcgauaauaggucagguuauucuggcauuuucucuguugagggcaaaagcugcaucaauaggugcuuuuauguggaguugauaaggggaagggaacaggagacuagaguaugguggaccucaaacaguauuguuguguuuuguggcacuucagguaccuaugggacaggcucauggccugauggggcggacaucaaucucaugccuauauaa

SEQ ID NO: 45477 - RNA, 1410 nt, Artificial Sequence
  neuraminidase__InfluenzaA__ABE12650
augaauccaaaucaaaagauaauaacgauuggcucuguuucucucacuauugccacaauauguuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauuaaggaggggaaaaucguucauauuagcccauuguuaggaagugcucaacaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuucuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45478 - RNA, 1410 nt, Artificial Sequence
  neuraminidase__InfluenzaA__ABE13095
augaauccaaaucaaaagauaauaacaauuggcucuguuucucucacuauuaccacaauaugcuuccuuaugcaaauugccauccugguaauuacuguaacauugcauuucaagcaaugugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacacgauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcgaguuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacggcuccagcaguagcuauugccuggauccuaacaaugaggaagggggucauggagugaaaggcugggccuuugaugauggaaaugauguguggaugggaagaacgaucagugagaaguuacgcucagguuaugaaaccuucaaagucauuggaggcugguccaagccuaacuccaaauugcagauaaauaggcaagucauaguugacaaagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45479 - RNA, 1410 nt, Artificial Sequence; identical to SEQ ID NO: 45372
  neuraminidase__InfluenzaA__ABE13332

SEQ ID NO: 45480 - RNA, 1410 nt, Artificial Sequence; identical to SEQ ID NO: 45416
  neuraminidase__InfluenzaA__ABE13558

SEQ ID NO: 45481 - RNA, 1410 nt, Artificial Sequence
  neuraminidase__InfluenzaA__ABE13642
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagagagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccucggacagggaacaacacuaaacaacaggcauucaaaugacacaguacaugagaggaccccuuaucggacccuauugaugaaugaguuggguguuccauuucauuugggaaccaagcaaguaugcauagcaugguccaguucaaguugucacgauggaaaagcauggcugcauguuuguguaacugggcaugaugaaaaugcaacugcuagcuucauuuacaaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccacugucaggaagugcucaacaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugauguguggaugggaagaacgaucagugagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45482 - RNA, 1410 nt, Artificial Sequence
  neuraminidase__InfluenzaA__ABE13668
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagagagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccucggacagggaacaacacuaaacaacaggcauucaaaugacacaguacaugauaggaccccuuaucggacccuauugaugaaugaguuggguguuccauuucauuugggaaccaagcaaguaugcauagcaugguccaguucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccacugucaggaagugcucaacaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugauguguggaugggaagaacgaucagugagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45483 - RNA, 1410 nt, Artificial Sequence
  neuraminidase__InfluenzaA__ABE13836
augaauccaaaucaaaagauaauaacaauuggcucuguuucucucacuauugccacaauaugcuuccuuaugcaaauugccauccugguaacuacuguaacauugcauuucaagcaauaugaaugcaacucccucccaaacaaccaaguaaugcugugugaaccaacaauaauagagagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccucggacagggaacaacacuaaacaacaggcauucaaaugacacaguacaugauaggaccccuuaucggacccuauugaugaaugaguuggguguuccauuucauuugggaaccaagcaaguaugcauagcaugguccaguucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucaacaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45484 - RNA, 1410 nt, Artificial Sequence
  neuraminidase__InfluenzaA__ABE14033
augaauccaaaucaaaagauaauaacaauuggcucuguuucucucacuauugccacaauaugcuuccuuaugcaaauugccauccugguaacuacuguaacauuacauuucaagcaauaugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccugaauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45485 - RNA, 1410 nt, Artificial Sequence
  neuraminidase__InfluenzaA__ABE14055
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagaaaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauuaguucaugguccaaaaauauccucaggacccaggagucggaaugcguuuguaucaauggaacuuguacaguaguaaugacugauggaaguucuucaggaagagcugauacuaaaauacuauucauugaagaggggaaaauuguucauauuagcccauugucaggaagugcucagcaugucgaggagugcuccuguuauccucgauacccuggugucagaugugucugcagagacaacuggaaaggcuccaauaggcccaucguagauauaaaugugaaagauuauagcauuguuuccaguuaugugugcucaggacuuguuggagacacacccagaaaaaaugacagcuccagcaguagcuauugccugaauccuaacaaugaggaagggggucauggagugaaaggcugggccuuugaugauggaaaugacguguggaugggaagaacgaucagcgaaaaguuacgcucagguuaugaaaccuucaaggucauuggaggcugguccaaaccuaacuccaaauugcagauaaauaggcaagucauaguugacagagguaauagguccgguuauucugguauuuucucuguugaaggcaaaagcugcgucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45486 - RNA, 1410 nt, Artificial Sequence
  neuraminidase__InfluenzaA__ABE14857
augaauccaaaucaaaagauaauaacaauuggcucuguuucucucacuauugccacaauaugcuuccuuaugcaaauugccauccugguaacuacuguaacauuacauuucaagcaauaugaaugcaacucccccccaaacaaccaaguaaugcugugugaaccaacaauaauagaaagaaacacaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccugaauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45487 - RNA, 1410 nt, Artificial Sequence; identical to SEQ ID NO: 45484
  neuraminidase__InfluenzaA__ABE15594

SEQ ID NO: 45488 - RNA, 1413 nt, Artificial Sequence
  neuraminidase__InfluenzaA__ABE26994
augaauccaaaucaaaaaauaauaaccauuggaucaaucaguauugcaauuggaauaauuagucugauauugcaaauaggaaauauuauuucaauaugggcuagccacucaauccaaacuggaagucaaaaccacacuggaauaugcaaccaaagaaucauuacauaugaaaauagcaccuggguaaaucaaacauauguuaauauuaacaacacuaauguuguugcuggaaaggacaaaaccucaaugacauuggccggcaauucaucucuuugcccuauccguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaauuucugguccagauaauggggcaguggcuguacuaaaauacaacggcauaauaacugaaaccauuaaaaguuggaagaagcgaauauuaagaacacaagagucugaaugugucuguaugaacgguucauguuuuaccauaaugaccgauggcccgaguaauggggccgcaucguacagaaucuucaaaaucgagaaggggagaguuacuaaaucaauagaguuggaugcacccaauuaucauuacgaggaauguucauguuacccagacaccggcacagugaugugugugugcagggacaauuggcacaguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugaaacaggauaucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 45489 - RNA, 1350 nt, Artificial Sequence
  neuraminidase__InfluenzaA__ABE97641
augaauccaaaucagaagauaauaaccauuggaucaaucuguaugguaauuggaauaauuagcuuaauguuacaaauugggaacaugaucucaauaugggucagucauucaauucagacguggaaucaacaccaagcugaaucaaucagcaauacuaacccucuuacugagaaagcuguggcuucaguaacauuagcaggcaauucaucucuuugccccauuagaggaugggcuguacacaguaaggacaacagcauaaggaucgguuccaagggggauguguuuguuauuagagagccguucaucucaugcucucacuuggaaugcagaacuuucuuuuugacucagggagccuugcugaaugacaagcacuccaacgggacugucaaagacagaagcccucacagaacauugaugaguuguccugugggugaggcuccuuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugauggaccaaguaaugggcaggcaucauauaagaucuucaaaauggaaaaagggaaagugguuaaaucagucgaauuggaugcuccuaauuaucacuaugaggagugcuccuguuauccugaugccggcgaaaucacaugugugugcagggauaauuggcauggcucaaauaggccauggauaucuuucaaucaaaauuuggaguaucaaauaggauauauaugcaguggaguuuucggagacaauccacgccccaaugauggaacagguaguugugguccgauguccccuaacggggcauaugggguaaaaggguuuucauuuaaauacggcaaugguguuuggaucgggagaaccaaaagcacuaauuccaggagcggcuuugaaaugauuugggauccaaauggguggauuggaacggacaguagcuuuucggugaaacaagauauaguagcaauaacugauuggucaggauauagugggaguuuuguccagcauccagaacugacaggauuagauuguauaagaccuuguuucuggguugaguuaaucagagggcggcccaaagagagcacaauuuggacuagugggagcagcauaucuuuuugugguguaaauagugacauugugaguuggucuuggccagacggugcugaguugccauucaccauugacaaguag

SEQ ID NO: 45490 - RNA, 1350 nt, Artificial Sequence
  neuraminidase__InfluenzaA__ABE97642
augaauccaaaucagaagauaauaaccauuggaucaaucuguaugguaauuggaaugguuagcuuaauguuacaaauugggaacaugaucucaauauggcucagucauucaauucagacagggaaucaacaccaagcugaaucaaucagcaauaauaaccuucuuacugagaacgcuguggcuucaguaacauuagcgggcaauucaucucuuugccccauuagaggaugggcuguacacaguaaggacaacaguauaaggaucgguuccaagggggauguguuuguuauuagagagccguucaucucaugcucccacuuggaaugcagaacuuucuuuuugacucagggagccuugcugaaugacaagcacuccaacgggacugucaaagacagaagcccucacagaacauugaugaguuguccugugggugaggcucccuccccauauaacucaagguuugagucuguugcuuggucagcaagugcuugccaugauggcaucaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugauggaccaaguaaugggcaggcaucauauaagaucuucaaaauggaaaaagggaaagugguuaaaucagucgaauuggaugccccuaauuaucacuaugaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugugguccgauguccccuaacggggcauaugggguaaaaggguuuucauuuaaauauggcaaugguguuuggaucgggagaaccaaaagcacuaauuccaggagcggcuuugaaaugauuugggauccaaauggguggacuggaacggacaguagcuuuucggugaaacaagauauaguagcaauaacugauuggucaggauauagcgggaguuuuguccagcauccagaacugacaggauuagauugcauaagaccuuguuucuggguugaguuaaucagagggcggcccaaagagagcacaauuuggacuagugggagcagcauaucuuuuugugguguaaauggugacacugugaguuggucuuggccagacggugcugaguugccauucaucauugacaaguag

SEQ ID NO: 45491 - RNA, 1350 nt, Artificial Sequence
  neuraminidase__InfluenzaA__ABE97644
augaauccaaaucagaagauaauaaccauuggaucaaucuguaugguaauuggaauaguuagcuuaauguuacaaauugggaacaugaucucaauaugggucagucauucaauucagacagggaaucaacaccaagcugaaucaaucagcaauacuaacccucuuacugagaaagcuguggcuucaguaacauuagcgggcaauucaucucuuugccccauuagaggaugggcuguacacaguaaggacaacaauauaaggaucgguuccaagggggauguguuuguuauuagagagccguucaucucaugcucccaccuggaaugcagaacuuucuuuuugacucagggagccuugcugaaugacaagcacuccaacgggacugucaaagacagaagcccucacagaacauugaugaguuguccugugggugaggcucccucuccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugauggaccaaguaaugggcaggcaucauauaagaucuucaaaauggaaaaaggaaaaguggucaaaucagucgaacuggaugcuccuaauuaucacuaugaggagugcuccuguuauccugaugccggcgaaaucacauguguuugcagggauaauuggcauggcucaaacaggccauggguaucuuucaaucaaaauuuggaguaucaaauaggguauauaugcaguggaguuuucggagacaauccacgccccaaugauggaacagguaguuguggcccgauguccccuaauggggcauaugggguaaaaggguuuucauucaaauacggcaaugguguuuggaucgggagaaccaaaagcacuaauuccaggagcggcuuugaaaugauuugggauccaaauggguggacuggaacggacaguagcuuuucggugaaacaagauauaguagcauuaacugauuggucaggauauagcgggaguuuuguccagcauccagaacugacgggauuagauugcauaagaccuuguuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 45492 - RNA, 1350 nt, Artificial Sequence
  neuraminidase__InfluenzaA__ABE97645
augaauccaaaucagaagauaauaaccauuggauccaucuguaugguaauuggaacaguuagcuuaauguuacaaauugggaacaugaucucaauaugggucagucauucaauucagacagggaaccaacaccaagcugaaccaaccagcaguacuaacccucuuacugagaaagcuguggcuucaguaacauuagcgggcaauucaucucuuugccccauuagaggaugggcuauacacaguaaggacaacaguauaaggaucgguuccaagggggauguguuuguuauuagagagccguuuaucucaugcucucacuuggaaugcagaacuuucuuuuugacucagggagccuugcugaaugacaagcacuccaacgggacugucaaagacagaagcccucacagaacauugaugaguuguccugugggugaggcucccuccccauacaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugauggaccaaguaaugggcaggcaucauauaagaucuucaaaauggaaaaagggaaagugguuaaaucagucgaauuggaugcuccuaauuaucacuaugaggagugcuccuguuauccugaugccggcgaaauuacaugugugugcagggauaauuggcauggcucaaauaggccauggguaucuuucaaucaaaauuuggaguaucaaauaggauauauaugcaguggaguuuucggagacaauccacgccccaaugauggaacagguaguugugguccgauguccccuaacggggcauaugggguaaaaggguuugcauuuaaauacggcaaugguguuuggaucgggagaaccaaaagcacuaauuccaggagcggcuuugaaaugauuugggauccaaauggguggacuggaccggacaguagcuuuucggugaaacaagauauaguagcaauaacugauuggucaggauauagcgggaguuuuguccagcauccagaacugacaggauuagauugcauaagaccuuguuucuggguugaguuaaucagagggcggcccaaagagagcacaauuuggacuagugggagcagcauauccuuuugugguguaaauagugacacugugaguuggucuuggccagacggugcugaguugccauucaccauugacaaguag

SEQ ID NO: 45493 - RNA, 1350 nt, Artificial Sequence
  neuraminidase__InfluenzaA__ABE97646
augaauccaaaucagaagauaauaaccauuggaucaaucuguaugguaauuggaauaguuagcuuaauguugcaaauugggaacaugaucucaauaugggucagucauucaauucagacagagaaucaacaccaagcugaaucaaucagcaauacuaacccuccuacugagaaagcuguggcuucaguaacauuagcgggcaauucaucucuuugccccauuagaggaugggcuguacacaguaaggacaacaguauaaggaucgguuccaagggggauguguuuguuauuagagagccauucaucucaugcucccacuuggaaugcagaacuuucuuuuugacucagggagccuugcugaaugacaagcacuccaacgggacugucaaagacagaagcccucacagaacauugaugaguuguccugugggagaggcucccuccccauacaacucaagguuugagucuguugcuuggucagcaagugcuugccaugauggcaccaguugguugacaaucggaauuucuggcccagacaauggggcuguggcuguauugaaauacaauggcauaauaacagacacuaucaagaguuggaggaacaacacgcugagaacucaagagucugaaugugcauguguaaauggcucuugcuuuacuguaaugacugauggaccaaguaaugggcaagcaucauauaagaucuucaaaauggaaaaagggaaagugguuaaaucagucgaauuggaugcuccuaauuaucacuaugaggagugcuccuguuauccugaugccggcgaaaucacaugugugugcagggauaauuggcauggcucaaauaggccauggguaucuuucaaucaaaauuuggaauaucaaauaggauauauaugcaguggaguuuucggagacaauccacgccccaaugauggaacagguaguugugguccgauguccccuaacggggcauaugggguaaaaggguuuucauuuaaauacggcaaugguguuuggaucgggagaaccaaaagcacuaauuccaggagcggcuuugaaaugauuugggauccaaauggguggacuggaacggacaguagcuuuucggugaaacaagauauaguaucaauaacugauuggucaggauauagcgggaguuuuguccagcauccagaacugacaggauuagauugcauaagaccuuguuucuggguugaguuaaucagagggcggcccaaagagagcacaauuuggacuagugggagcagcauaucuuuuugugguguaaauagugacacugugaguuggucuuggccagacggugcugaguugccguucaccauugacaaguag

SEQ ID NO: 45494 - RNA, 1350 nt, Artificial Sequence
  neuraminidase__InfluenzaA__ABE97647
augaauccaaaucagaagauaauaaccauuggaucaaucuguaugguaauuggaauaguuagcuuaauguuacaaauugggaacaugaucucaauaugggucagucauucaauucagacagggaaucaacaccgagcugaaucaaucagcaauacuaacccucuuacugagaaagcuguggcuucaguaacauuagcgggcaauucaucucuuugccccauuagaggaugggcuguacacaguaaggacaacaauauaaggaucgguuccaagggggauguguuuguuauuagagagccguucaucucaugcucccaccuggaaugcagaacuuucuuuuugacucagggagccuugcugaaugacaagcacuccaacgggacugucaaagacagaagcccucacagaacauugaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugauggaccaaguaaugggcaggcaucauauaagaucuucaaaauggaaaaagggaaagugguuaaaucagucgaauuggaugcuccuaauuaucacuaugaggagugcuccuguuauccugaugccggcgagaucacauguguuugcagggauaauuggcauggcucaaauaggccauggguaucuuucaaucaaaauuuggaguaucaaauaggauauauaugcaguggaguuuucggagacaauccacgccccaaugauggaacagguaguugugguccgauguccccuaacggggcauaugggguaaaaggguucucauuuaaauacggcaaugguguuuggaucgggagaaccaaaagcacuaauuccaggagcggcuuugaaaugauuugggauccaaauggguggacuggaacggacaguagcuuuucggugaaacaagauauaguagcaauaacugauuggucaggauauagcgggaguuuuguccagcauccagaacugacaggauuagauugcauaagaccuuguuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 45495 - RNA, 1350 nt, Artificial Sequence
  neuraminidase__InfluenzaA__ABE97649
augaauccaaaucagaagauaauaaccauuggaucaaucuguaugguaauuggaauaguuagcuuaauguuacaaauugggaacaugaucucaauaugggucagucauucaauucagacagggaaucaacaccaagcugaaucaaucagcaauacuaacccucuuacugagaaagcuguggcuucaguaacauuagcgggcaauucaucucuuugccccauuagaggaugggcuguacacaguaaggacaacaguauaaggaucgguuccaagggggauguguuuguuauuagagagccguucaucucaugcucucacuuggaaugcagaacuuucuuuuugacucagggagccuugcugaaugacaagcacuccaacgggacugucaaagacagaagcccucacagaacauugaugaguuguccugugggugaggcucccuccccauacaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugaugggccaaguaaugggcaggcaucauauaagaucuucaaaauggaaaaagggaaagugguuaaaucagucgaauuggaugcuccuaauuaucacuaugaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugugguccgauguccccuaacggggcauaugggguaaaaggguuuucauuuaaauacggcaaugguguuuggaucgggagaaccaaaagcacuaauuccaggagcggcuuugaaaugauuugggauccaaauggguggacuggaacggacaguagcuuuucggugaaacaagauauaguagcaauaacugauuggucaggauauagcgggaguuuuguccagcauccagaacugacaggauuagauugcauaagaccuuguuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 45496 - RNA, 1350 nt, Artificial Sequence; identical to SEQ ID NO: 45495
  neuraminidase__InfluenzaA__ABE97651

SEQ ID NO: 45497 - RNA, 1350 nt, Artificial Sequence; identical to SEQ ID NO: 45495
  neuraminidase__InfluenzaA__ABE97653

SEQ ID NO: 45498 - RNA, 1350 nt, Artificial Sequence; identical to SEQ ID NO: 45495
  neuraminidase__InfluenzaA__ABE97654

SEQ ID NO: 45499 - RNA, 1350 nt, Artificial Sequence
  neuraminidase__InfluenzaA__ABE97655
augaauccaaaucagaagauaauaaccauuggauccaucuguauggcaauuggaauaguuagcuuaauguuacaaauugggaacaugaucucaauaugggucagucauucaauucagacagggaaucaacaccaagcugaaucaaccagcaauacuaacccucuuacugagaaagcuguggcuucaguaacauuagcgggcaauucaucucuuugccccauuagaggaugggcuauacacaguaaggacaacaguauaaggaucgguuccaagggggauguguuuguuauuagagagccguucaucucaugcucucacuuggaaugcagaacuuucuuuuugacucagggagccuugcugaaugacaagcacuccaacgggacugucaaagacagaagcccucacagaacauugaugaguuguccugugggugaggcucccuccccauacaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugauggaccaaguaaugggcaggcaucauauaagaucuucaaaauggaaaaagggaaagugguuaaaucagucgaauuggaugcuccuaauuaucacuaugaggagugcuccuguuauccugaugccggcgagaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugugguccgauguccccuaacggggcauaugggguaaaaggguuugcauuuaaauacggcaaugguguuuggaucgggagaaccaaaagcacuaauuccaggagcggcuuugaaaugauuugggauccaaauggauggacuggaccggacaguagcuuuucggugaaacaagauauaguagcaauaacugauuggucaggauauagcgggaguuuuguccagcauccagaacugacaggauuagauugcauaagaccuuguuucuggguugaguuaaucagagggcggcccaaagagagcacaauuuggacuagugggagcagcauauccuuuugugguguaaauagugacacugugaguuggucuuggccagacggugcugaguugccauucaccauugacaaguag

SEQ ID NO: 45500 - RNA, 1350 nt, Artificial Sequence
  neuraminidase__InfluenzaA__ABE97657
augaauccaaaucagaagauaauaaccauuggaucaaucuguaugguaaucggaacaguuagcuuaguguuacaaauugggaacaugaucucaauaugggucagucauucaauucagacagggaaccaacaccaagcugaaucaaucagcaauacuaacccucuuacugagaaagcuguggcuucaguaacauuggcaggcaauucgucucuuugccccauuagaggaugggcuguacacaguaaggacaacaguauaaggaucgguuccaagggggauguguuuguuauuagagagccguucaucucaugcucccacuuggaaugcagaacuuucuuuuugacucagggagccuugcugaaugacaagcacuccaacgggacugucaaagacagaagcccucacagaacauugaugaguuguccugugggugaggcucccucuccauacaacucaagguuugagucuguugcuuggucagcaagugcuugccaugauggcaccaguugguugacaauuggaauuucuggcccagacaauggggcuguggcuguguugaaauacaauggcauaauaacagacacuaucaagaguuggagggacaacauacugagaacucaagagucugaaugugcauguguaaauggcucuugcuuuacuguaaugacugauggaccaaguaaugggcaggcaucauauaagaucuucaaaauggaaaaagggaaagugguuaaaucagucgaauuggaugcucccaauuaucacuaugaggagugcuccuguuauccugaugcuggcgaaaucacaugugugugcagggauaauuggcauggcucaaauaggccauggguauccuucaaucaaaauuuggaguaucaaauaggauauauaugcaguggaguuuucggagacaauccacgccccaaugauggaacagguaguugugguccgauguccucuaacggggcauaugggguaaaaggguuuucauuuaaauacggcaaugguguuuggaucgggagaaccaaaagcacuaauuccagaagcggcuuugaaaugauuugggauccaaauggguggacuggaacggacaguagcuuuucggugaaacaagauauaguagcaauaacugauuggucaggauauagugggaguuuuguccagcauccagaacugacaggauuagauugcauaagaccuuguuucuggguugaguuaaucagagggcgacccaaagagagcacaauuuggacuagugggagcagcauaucuuuuugugguguaaauagugacacugugaguuggucuuggccagacggugcugaguugccauucaccauugacaaguaa

SEQ ID NO: 45501 - RNA, 1350 nt, Artificial Sequence
  neuraminidase__InfluenzaA__ABE97658
augaauccaaaucagaagauaauaaccauugggucaaucuguaugguaauuggaacaauuagcuuaauguuacaaauugggaacaugaucucaauaugggucagucauucaauucagacagggaaccaacaccaaacugaaucaaucagcaauacuaacccucuuacugagaaagcuguggcuucaguaacauuggcaggcaauucgucucuuugcuccauuagaggaugggcuguacacaguaaggacaacaguauaaggaucgguuccaagggggauguguuuguuauuagagagccguucaucucaugcucccacuuggaaugcagaacuuucuuuuugacucagggagccuugcugaaugacaagcacuccaacgggacugucaaagacagaagcccucacagaacauugaugaguuguccugugggugaggcucccucuccauauaacucaagauuugagucuguugcuuggucagcaagugcuugccaugauggcaccaguugguugacaauuggaauuucuggcccagacaauggggcuguggcuguguugaaauacaauggcauaauaacagacacuaucaagaguuggagggacaacauacugagaacucaagagucugaaugugcauguguaaauggcucuugcuuuacuguaaugacugauggaccaaguaaugggcaggcaucauauaagaucuucaaaauggaaaaagggaaagugguuaaaucagucgaauuggaugcucccaauuaucacuaugaggagugcuccuguuauccugaugcuggcgaaaucacaugugugugcagggauaauuggcauggcucaaauaggccauggguauccuucaaucaaaauuuggaguaucaaauaggauauauaugcaguggaguuuucggagacaauccacgccccaaugauggaacagguaguuguggcccgauguccucuaacggggcacaugggguaaaaggguuuucauuuaaauacggcaaugguguuuggaucgggagaaccaaaagcacuaauuccagaagcggcuuugaaaugauuugggauccaaauggguggacuggaacggacaguagcuuuucggugaaacaagauauaguagcaauaacugauuggucaggauauagugggaguuuuguccagcauccagaacugacaggauuagauugcauaagaccuuguuucuggguugaguuaaucagagggcgaccaaaagagagcacaauuuggacuagugggagcagcauaucuuuuugugguguaaauagugacacugugaguuggucuuggccagacggugcugaguugccauucaccauugacaaguaa

SEQ ID NO: 45502 - RNA, 1350 nt, Artificial Sequence
  neuraminidase__InfluenzaA__ABE97659
augaauccaaaucagaagauaauaaccauuggaucaaucuguaugguaauuggaauaguuagcuuaauguuacaaauugggaacaugaucucaauaugggucagucauucaauucagacagggaaccaacaccaagcugaaucaaucagcaauacuaacccucuuacugagaaagcuguggcuucaguaacauuggcaggcaauucgucucuuugccccauuagaggaugggcuguacacaguaaggacaacaguauaaggaucgguuccaagggggauguguuuguuauuagagagccguucaucucaugcucccacuuggaaugcagaacuuucuuuuugacucagggagccuugcugaaugacaagcacuccaacgagacugucaaagacagaagcccucacagaacauugaugaguuguccugugggugaggcucccucuccauacaacucaagguuugagucuguugcuuggucagcaagugcuugccaugauggcaccaguugguugacaauuggaauuucuggcccagacaauggggcuguggcuguguugaaauacaauggcauaauaacagacacuaucaagaguuggagggacaacauacugagaacucaagagucugaaugugcauguguaaauggcucuugcuuuacuguaaugacugauggaccaaguaaugggcaggcaucauauaagaucuucaaaauggaaaaaggaaaagugguuaaaucagucgaauuggaugcucccaauuaucacuaugaggagugcuccuguuauccugaugcuggcgaaaucacaugugugugcagggauaauuggcauggcucaaauaggccauggguauccuucaaucaaaauuuggaguaucaaauaggauauauaugcaguggaguuuucggagacaauccacgccccaaugauggaacagguaguugugguccgauguccucuaacggggcauaugggguaaaaggguuuucauuuaaauacggcaaugguguuuggaucgggagaaccaaaagcacuaauuccagaagcggcuuugaaaugauuugggauccaaauggguggacuggaacggacaguagcuuuucggugaaacaagauauaguagcaauaacugauuggucaggauauagugggaguuuuguccagcauccagaacugacaggauuagauugcauaagaccuuguuucuggguugaguuaaucagagggcgacccaaagagagcacaauuuggacuagugggagcagcauaucuuuuugugguguaaauagugacacugugaguuggucuuggccagacggugcugaguugccauucaccauugacaaguaa

SEQ ID NO: 45503 - RNA, 1350 nt, Artificial Sequence
  neuraminidase__InfluenzaA__ABE97660
augaauccaaaucagaagauaauaaccauugggucaaucuguaugguaauuggaacaauuagcuuaauguuacaaauugggaacaugaucucaauaugggucagucauucaauucagacagggaaccaacaccaagcugaaucaaucagcaauacuaacccucuuacugagaaagcuguggcuucaguaacauuggcaggcaauucgucucuuugccccauuagaggaugggcuguacacaguaaggacaacaguauaaggaucgguuccaagggggauguguuuguuauuagagagccguucaucucaugcucccacuuggaaugcagaacuuucuuuuugacucagggagccuugcugaaugacaagcacuccaacgggacugucaaagacagaagcccucacagaacauuaaugaguuguccugugggugaggcucccucuccauauaacucaagauuugagucuguugcuuggucagcaagugcuugccaugauggcaccaguugguugacaauuggaauuucuggcccagacaauggggcuguggcuguguugaaauacaauggcauaauaacagacacuaucaagaguuggagggacaacauacugagaacucaagagucugaaugugcauguguaaauggcucuuguuuuacuguaaugacugauggaccaaguaaugggcaggcaucauauaagaucuucaaaauggaaaaagggaaaguaguuaaaucagucgaauuggaugcucccaauuaucacuaugaggagugcuccuguuauccugaugcuggcgaaaucacaugugugugcagggauaauuggcauggcucaaauaggccauggguauccuucaaucaaaauuuggaguaucaaauaggauauauaugcaguggaguuuucggagacaauccacgccccaaugauggaacagguaguuguggcccgauguccucuaacggggcacaugggguaaaaggguuuucauuuaaauacggcaaugguguuuggaucgggagaaccaaaagcacuaauuccagaagcggcuuugaaaugauuugggauccaaauggguggacuggaacggacaguagcuuuucggugaaacaagauauaguagcaauaacugauuggucaggauauagugggaguuuuguccagcauccagaacugacaggauuagauugcauaagaccuuguuucuggguugaguuaaucagagggcgaccaaaagagagcacaauuuggacuagugggagcagcauaucuuuuugugguguaaauagugacacugugaguuggucuuggccagacggugcugaguugccauucaccauugacaaguaa

SEQ ID NO: 45504 - RNA, 1350 nt, Artificial Sequence
  neuraminidase__InfluenzaA__ABE97661
augaauccaaaucagaagauaauaaccauugggucaaucuguaugguaauuggaacaauuagcuuaauguuacaaauugggaacaugaucucaauaugggucagucauucaauucagacagggaaccaacaccaaacugaaucaaucagcaauacuaacccucuuacugagaaagcuguggcuucaguaacauuggcaggcaauucgucucuuugccccauuagaggaugggcuguacacaguaaggacaacagcauaaggaucgguuccaagggggauguguuuguuauuagagagccguucaucucaugcucccacuuggaaugcagaacuuucuuuuugacucagggagccuugcugaaugacaagcacuccaacgggacugucaaagacagaagcccucacagaacauugaugaguuguccugugggugaggcucccucuccauauaacucaagauuugagucuguugcuuggucagcaagugcuugccacgauggcaccaguugguugacaauuggaauuucuggcccagacaauggggcuguggcuguguugaaauacaauggcauaauaacagacacuaucaagaguuggagggacaacauacugagaacucaagagucugaaugugcauguguaaauggcucuugcuuuacuguaaugacugauggaccaaguaaugggcaggcaucauauaagaucuucaaaauggaaaaagggaaagugguuaaaucagucgaauuggaugcucccaauuaucacuaugaggagugcuccuguuauccugaugcuggcgaaaucacaugugugugcagggauaauuggcauggcucaaauaggccauggguauccuucaaucaaaauuuggaguaucaaauaggauauauaugcaguggaguuuucggagacaauccacgccccaaugauggaacagguaguuguggcccgauguccucuaacggggcacaugggguaaaaggguuuucauuuaaauacggcaaugguguuuggaucgggagaaccaaaagcacuaauuccagaagcggcuuugaaaugauuugggauccaaauggguggacuggaacggacaguagcuuuucggugaaacaagauauaguagcaacaacugauuggucaggauauagugggaguuuuguccagcauccagaacugacaggauuagauugcauaagaccuuguuucuggguugaguuaaucagagggcgaccaaaggagagcacaguuuggacuagugggagcagcauaucuuuuugugguguaaauagugacacugugaguuggucuuggccagacggugcugaguugccauucaccauugacaaguaa

SEQ ID NO: 45505 - RNA, 1350 nt, Artificial Sequence
  neuraminidase__InfluenzaA__ABE97662
augaauccaaaucagaagauaauaaccauuggaucaaucuguaugguaauuggaauaguuagcuuaauguuacaaauugggaacaugaucucaauaugggucagucauucaauccagacagggaaccaacaccaagcugaaucaaucagcaauacuaacccucuuacugagaaagcuguggcuucaguaacauuagcgggcaauucaucucuuugccccauuagaggaugggcuguacacaguaaggacaacaguauaaggaucgguuccaagggggauguguuuguuauuagagagccguucaucucaugcucccacuuggaaugcagaacuuucuuuuugacucagggagccuugcugaaugacaagcacuccaacgggaccgucaaagacagaagcccucacagaacauugaugaguuguccugugggugaggcucccucuccauauaacucaagguuugagucuguugcuuggucagcaagugcuugccaugauggcaccaguugguugacaauuggaauuucuggcccagacaauggggcuguggcuguguugaaauacaauggcauaauaacagacacuaucaagaguuggaggaacaacauacugagaacucaagagucugaaugugcauguguaaauggcucuugcuuuacuguaaugacugauggaccaaguaaugggcaggcaucauauaagaucuucaaaaugagaaaagggaaagugguuaaaucagucgaauuggaugcucccaauuaucacuaugaggagugcuccuguuauccugaugccggcgaaaucacaugugugugcagggauaauuggcauggcucaaauaggccauggguauccuucaaucaaaauuuggaguaucaaauaggauauauaugcaguggaguuuucggagacaauccacgccccaaugauggaacagguaguugugguccgauguccccuaacggggcauaugggguaaaaggguuuucauuuaaauacggcaaugguguuuggaucgggagaaccaaaagcacuaauuccaggagcggcuuugaaaugauuugggauccaaauggguggacuggaacggacaguagcuuuucggugaaacaagauauaguagcaauaacugauuggucaggauauagugggaguuuuguccagcauccagaacugacaggauuagauugcauaagaccuuguuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 45506 - RNA, 1350 nt, Artificial Sequence
  neuraminidase__InfluenzaA__ABE97663
augaauccaaaucagaagauaauaaccaucggaucaaucuguaugguaacuggaauaguuagcuuaauguuacaaauugggaacaugaucucaauaugggucagucauucaauucacacagggaaucaacaccaagcugaaccaaucagcaauacuaauuuucuuacugagaaagcuguggcuucaguaaaauuagcgggcaauucuucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauauugagaacucaagagucugaaugugcauguguaaauggcucuugcuuuacuguaaugacugacggaccaaguaauggucaagcaucacauaagaucuucaaaauggaaaaagggaaagugguuaaaucagucgaauuggaugcuccuaauuaucacuaugaggaaugcuccuguuauccugaugccggcgaaaucacgugugugugcagggauaauuggcauggcucaaaucggccauggguaucuuucaaucaaaauuuggaguaucaaauaggauauauaugcaguggaguuuucggagacaauccacgccccaaugauggaacagguaguugcgguccgguguccucuaacggggcauaugggguaaaaggguuuucauuuagguacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45507 - RNA, 1350 nt, Artificial Sequence
  neuraminidase__InfluenzaA__ABE97665
augaauccaaaucagaagauaauaaccaucggaucaaucuguaugguaacuggaauaguuagcuuaauguuacaaguugggaacaugaucucaauaugggucagucauucaauucacacagggaaucaacaccaagcugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucauggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaacuuggaguaucaaauaggauauauaugcaguggaguuuucggagacaauccacgccccaaugauggaacagguaguugugguccaguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45508 - RNA, 1350 nt, Artificial Sequence
  neuraminidase__InfluenzaA__ABE97666
augaauccaaaucagaagauaauaaccaucggaucaaucuguaugguaacuggaauaguuagcuuaauguuacaaauugggaacaugaucucaauaugggucagucauucaauucacacagggaaucaacaccaaucugaaccaaucagcaauacuaauuuucuuacugagaaagcuguggcuucaguaaaauuagcgggcaauucaccucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuuccggcccagacaauggggcuguggcuguauugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacauguguaugcagggauaauuggcaugguucaaaucggccauggguaucuuucaaccaaaauuuggaguaucaaauaggauauauaugcaguggaguuuucggagacaguccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45509 - RNA, 1350 nt, Artificial Sequence
  neuraminidase__InfluenzaA__ABE97667
augaauccaaaucagaagauaauaaccaucggaucaaucuguaugguaacuggaaucguuagcuuaauguuacaaauugggaacaugaucucaauauggggcagucauucaauucacacagggaaucaacaccaaucugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccauuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucugucgcuuggucagcaagugcuugccaugauggcaccaguugguugacaauugguauuucuggcccagacaacggggcuguggcuguagugaaguacaauggcauaauaacugacacuaucaagaguuggaggaacaacauacugagaacucaagagucugagugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuacgaggaaugcuccuguuauccugaugcuggcaaaaucacaugugugugcagggauaauuggcauggcucaaaucggccauggguaucuuucaaucaaaauuuggaguaucaaauaggauauauaugcaguggaguuuucggagacaauccacgccccaaugauggaacagguaguugugguccgguguccucuaacggagcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacauuguggguuggucuuggccagacggugcugaguugccauucaccauugacaaguag

SEQ ID NO: 45510 - RNA, 1350 nt, Artificial Sequence
  neuraminidase__InfluenzaA__ABE97669
augaauccaaaucagaagauaauaaccaucggaucaaucuguaugguaacuggaauaguuagcuuaauguuacaaauugggaacaugaucucaauaugggucagucauucaauucacacagggaaucaacaccaaucugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucugucgcuuggucagcaagugcuugccaugauggcaccaguugguugacaauugguauuucuggcccagacaauggggcuguggcuguagugaaguacaauggcauaauaacagacacuaucaagaguuggaggaacaacauacugagaacucaagagucugagugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccaugggugucuuucaaucaaaauuuggaguaucaaauaggauauauaugcaguggaguuuucggagacaauccacgccccaaugauggaacagguaguugugguccgguguccucuaacggggcauaugggguaaaagguuuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45511 - RNA, 1350 nt, Artificial Sequence
  neuraminidase__InfluenzaA__ABE97670
augaauccaaaucagaagauaauaaccaucggaucaaucuguaugguaacuggaauaguuaguuuaauguuacaaauugggaacaugaucucaauaugggucagucauucaauucacacagggaaucaacaccaaucugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucugucgcuuggucagcaagugcuugccaugauggcaccaguugguugacaauugguauuucuggcccagacaauggggcuguggcuguagugaaguacaauggcauaauaacagacacuaucaagaguuggaggaacaacauacugagaacucaagagucugagugugcauguguaaauggcucuugcuuuacuguaaugacugacggaccaaguaauggucaggcaucacauaagaucuucaaaauggaaaaagggaaagugguuaaaucagucgaauuggauaccccuaauuaucacuaugaggaaugcuccuguuacccugaugccggcgaaaucacaugugugugcagggauaauuggcauggcucaaaucggccaugggugucuuucaaucaaaauuuggaguaucaaauaggauauauaugcaguggaguuuucggagacaauccacgccccaaugauggaacagguaguugugguccgguguccucuaacggggcauaugggguaaaagguuuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45512 - RNA, 1350 nt, Artificial Sequence
  neuraminidase__InfluenzaA__ABE97671
augaauccaaaucaaaagauaauaaccaucggaucaaucuguaugguaacuggaauaguuagcuuaauguuacaaauugggaacaugaucucaauaugggucagucauucaauucacacagggaaucaacaccaagcugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggaacagguaguugcgguccgguguccucuaacggggcauaugggguaaaaggguucucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45513 - RNA, 1350 nt, Artificial Sequence
  neuraminidase__InfluenzaA__ABE97672
augaauccaaaucagaagauaauaaccaucggaucaaucuguaugguaacuggaauaguuagcuuaauguuacagauugggaacaugaucucaauaugggucagucauucaauucacacagggaaucaacaccaagcugaaccaaucagcaauacuaauuuucuuacugagaaagcucuggcuucaguaaaauuagcgggcaauucaucucuuugccccauuaauggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugaccgacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggaacagguaguugugguccgguguccucuaauggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45514 - RNA, 1350 nt, Artificial Sequence
  neuraminidase__InfluenzaA__ABE97675
augaauccaaaucagaagauaauaaccaucggaucaaucuguaugguaacaggaauaguuagcuuaauguuacaaguugggaacaugaucucaauaugggucagucauucaauucacacagggaaucaacaccaagcugaaccaaucagcaauacuaauuuucuuauugagaaagcuguggcuucaguaaaauuagcgggcaauucaucucuuugccccauuaacggcugggcuguauacaguaaggacaacaguauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaauagaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaacuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggucugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45515 - RNA, 1350 nt, Artificial Sequence
  neuraminidase__InfluenzaA__ABE97676
augaauccaaaucagaagauaauaaccaucggaucaaucuguaugguaacuggaauaguuagcuuaauguuacaaauugggaacaugaucucaauaugggucagucauucaauucacacagggaaucaacaccaagcugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcaugugugaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccaugggugucuuucaaucaaaauuuggaguaucaaauaggauauauaugcaguggaguuuucggagacaauccacgccccaaugauggaacagguaguugugguccgguguccucuaacggggcauaugggguaaaaggauuuuccuuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaaaugauuggucaggauauagcgggaguuuuguccagcauccagaacugacaggacuagauuguauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45516 - RNA, 1350 nt, Artificial Sequence
  neuraminidase__InfluenzaA__ABE97677
augaauccaaaucagaagauaauaaccaucggaucaaucuguaugguaacuggaauaguuagcuuaauguuacaaauugggaacauaaucucaauaugggucaggcauucaauucacacagggaaucaacaccaaucugaaccaaucagcaacacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucugucgcuuggucagcaagugcuugccaugauggcaccaguugguugacaauugguauuucuggcccagacaauggggcuguggcuguagugaaguacaauggcauaauaacagacacuaucaagaguuggaggaacaacauacugagaacucaagagucugagugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45517 - RNA, 1350 nt, Artificial Sequence
  neuraminidase__InfluenzaA__ABE97679
augaauccaaaucagaagauaauaaccaucggaucaaucuguaugguaacuggaauaguuagcuuaauguuacaaauugggaacaugaucucaauaugggucaggcauucaauucacacagggaaucaacaccaaucugaaccaaucagcaacacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucugucgcuuggucagcaagugcuugccaugauggcaccaguugguugacaauugguauuucuggcccagacaauggggcuguggcuguagugaaguacaauggcauaauaacagacacuaucaagaguuggaggaacaacauacugagaacucaagagucugagugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45518 - RNA, 1350 nt, Artificial Sequence
  neuraminidase__InfluenzaA__ABE97680
augaauccaaaucagaagauaauaaccaucggaucaaucuguaugguaacuggaauaguuagcuuaauguuacaaauugggaacaugaucucaauaugggucagucauucaauucacacagggaaucaacaccaaucugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauugguauuucuggcccagacaauggggcuguggcuguagugaaauacaauggcauaauaacagacacuaucaagaguuggaggaacaacauacugagaacucaagagucugagugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcgacccaaagagagcacaauuuggacuagugggagcagcauaucuuuuugugguguaaauagugacacuguggguuggucuuggccagacggugcugaguugccauucaccauugacaaguag

SEQ ID NO: 45519 - RNA, 1350 nt, Artificial Sequence
  neuraminidase__InfluenzaA__ABE97681
augaauccaaaucagaagauaauaaccaucggaucaaucuguaugguaacuggaauaguuagcuuaauguuacaaauugggaacaugaucucaauaugggucagucauucaauucacacagggaaucaacaccaaucugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucugucgcuuggucagcgagugcuugccaugauggcaccaguugguugacaauugguauuucuggcccagacaauggggcuguggcuguagugaaguacaauggcauaauaacagacacuaucaagaguuggaggaacaacauacugagaacucaagagucugagugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccaugggugucuuucaaucaaaauuuggaguaucaaauaggauauauaugcaguggaguuuucggagacaauccacgccccaaugauggaacagguaguugugguccgguguccucuaauggggcauaugggguaaaagguuuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45520 - RNA, 1350 nt, Artificial Sequence; identical to SEQ ID NO: 45519
  neuraminidase__InfluenzaA__ABE97682

SEQ ID NO: 45521 - RNA, 1350 nt, Artificial Sequence
  neuraminidase__InfluenzaA__ABE97684
augaauccaaaucagaagauaauaaccaucggaucaaucuguaugguaacuggaauaguuagcuuaauguuacaaauugggaacaugaucucaauaugggucagucauucaauucacacagggaaucaacaccaagcugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauaguggcacuguggguuggucuuggccagacggugcugaguugccauucaccauugacaaguag

SEQ ID NO: 45522 - RNA, 1350 nt, Artificial Sequence
  neuraminidase__InfluenzaA__ABE97685
augaauccaaaucagaagauaauaaccaucggaucaaucuguaugguaacuggaauaguuagcuuaauguuacaaauugggaacaugaucucaauaugggucagucauucaauucacacagggaaucaacaccaagcugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuggggguuggucuuggccagacggugcugaguugccauucaccauugacaaguag

SEQ ID NO: 45523 - RNA, 1350 nt, Artificial Sequence
  neuraminidase__InfluenzaA__ABE97686
augaauccaaaucagaagauaauaaccaucggaucaaucuguaugguaacuggaauaguuagcuuaauguuacaaauugggaacaugaucucaauaugggucagucauucaauucacacagggaaucaacaccaagcugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45524 - RNA, 1350 nt, Artificial Sequence
  neuraminidase__InfluenzaA__ABE97687
augaauccaaaucagaagauaauaaccaucggaucaaucuguaugguaacuggaauaguuagcuuaauguuacaaguugggaacaugaucucaauaugggucagucauucaauucacacagggaaucaacaccaagcugaaccaaucagcaauacuaauuuucuuacugagaaagcuguggcuucaguaaaauuagcgggcaauucaucccuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaaacacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugauggaccaaguaauggucaggcaucacauaagaucuucaaaauggaaaaaggaaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaacuuggaguaucaaauaggauauauaugcagugggguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45525 - RNA, 1350 nt, Artificial Sequence
  neuraminidase__InfluenzaA__ABE97688
augaauccaaaucagaagauaauaaccaucggaucaaucuguaugguaacuggaauaguuagcuuaauguuacaaguugggaacaugaucucaauaugggucagucauucaauucacacagggaaucaacaccaagcugaaccaauaagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaaacacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguacugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaauggaaaaaggaaaagugauuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaacuuggaguaucaaauaggauauauaugcaguggaguuuucggagacaauccacgccccaaugauggaacagguaguugugguccgguguccucuaacggggcauaugggguaaaaggauuuucauuuaaauacggcaauggugucugggucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccggacggugcugaguugccauucaucauugacaaguag

SEQ ID NO: 45526 - RNA, 1350 nt, Artificial Sequence
  neuraminidase__InfluenzaA__ABE97690
augaauccaaaucagaagauaauaaccaucggaucaaucuguaugguaacuggaauaguuagcuuaauguuacaaguugggaacaugaucucaauaugggucagucauucaauucacacagggaaucaacaccaagcugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaaacacuccaaugggacugucaaagacagaagcccucacagaucauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaaugaaaaaaggaaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcaucccgaacugacagggcuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45527 - RNA, 1350 nt, Artificial Sequence
  neuraminidase__InfluenzaA__ABE97691
augaauccaaaucagaagauaauaaccaucggaucaaucuguaugguaacuggaauaguuagcuuaauguuacaaguugggaacaugaucucaauaugggucagucauucaauucacacagggaaucaacaccaagcugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuaaaagagagccgugcaucucaugcucccacuugaagugcagaacuuucuuuuugacucagggagccuugcugaaugacaaacacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaacuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacugugggcuggucuuggccagacggugcugaguugccauucaccauugacaaguag

SEQ ID NO: 45528 - RNA, 1350 nt, Artificial Sequence
  neuraminidase__InfluenzaA__ABE97694
augaauccaaaucagaagauaaugaccaucggaucaaucuguaugguaacuggaauaguuagcuuaauguuacaaguugggaacaugaucucaauaugggucagucauucaauucacacagggaaucaacaccaagcugaaccaaucagcaauacuaauuuucuuacugagaaagcuguggauucaguaaaauuagcgggcaauucaucucuuugccccauuaacggaugggcuguauacaguaaggacaacaguauaaggaucgguuccaagggggauguguuuguuauaagagagccgucugucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguacugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaauggaaaaaggaaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaacuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaacggguggacugaaacggacaguagcuuuucagugaaacaagaugucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45529 - RNA, 1350 nt, Artificial Sequence
  neuraminidase__InfluenzaA__ABE97696
augaauccaaaucagaagauaauaaccaucggaucaaucuguaugguaacuggaauaguuagcuuaauguuacaaguugggaacaugaucucaauaugggucagucauucaauucacacagggaaucaacaccaagcugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaaacacuccaaugggagugucaaagacagaagcccucacagaacauuaaugaguuguucugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugauggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaacuuggaguaucaaauaggauauauaugcagugggguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45530 - RNA, 1350 nt, Artificial Sequence
  neuraminidase__InfluenzaA__ABE97697
augaauccaaaucagaagauaauaaccaucggaucaaucuguaugguaacuggaauaguuagcuuaauguuacaaguugggaacaugaucucaauaugggucagucauucaauucacacagggaaucaacaccaagcugaaccaaucagcaauacuaauuuucuuaaugagaaagcuguggcuucaguaaaauuagcgggcaauucaucucuuugccccauuaacggaugggcuguauacaguaaggacaacaguauaaggaucgguuccaagggggauguguuuguuauaagagagccguucaucuccugcucccacuuggaaugcagaacuuucuuuuugacucagggagccuugcugaaugacaaacacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauuauaacagacacuaucaagaguuggaggaacaacauacugagaacucaagaaucugaaugugcauguguaaauggcucuugcuuuacuguaaugacugacggaccaaguaauggucaggcaucacauaagaucuucaaaauggaaaaagggaaagugguuaaaucaguugaauuggaugcuccuaauuaucacuaugaggaaugcuccuguuauccugaugccggcgaaaucacaugugugugcagggauaauuggcauggcucaaaucggccauggguaucuuucaaucaaaacuuggaguaucaaauaggauauauaugcaguggaguuuucggagacaauccacgccccaaugaugaaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagacaucguagcaauaacugauuggucaggauauagcgggaguuuuguccagcauccagaacugacaggacuagauugcauaagaccuuguuucuggguugaguugaucagagggcggcccaaagagagcaccauuuggacuagugggagcagcauaucuuuuugugguguaaauagugacacuguggguuggucuuggccagacggugcugaguugccguucaccauugacaaguag

SEQ ID NO: 45531 - RNA, 1350 nt, Artificial Sequence
  neuraminidase__InfluenzaA__ABE97702
augaauccaaaucagaagauaauaaccaucggaucaaucuguaugguaacuggaauaguuagcuuaauguuacaaguugggaacaugaucucaauaugggucagucauucaauucacacagggaaucaacaccaagcugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaaacacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugauggaccaaguaauggucaggcaucacauaagaucuucaaaauggaaaaagggaaagugguuaaaucagucgaauuggaugcuccuuauuaucacuaugaggaaugcuccuguuauccugaugccggcgaaaucacaugugugugcagggauaauuggcauggcucaaaucggccauggguaucuuucaaucaaaacuuggaguaucaaauaggauauauaugcagugggguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguaucaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccacugacaaguag

SEQ ID NO: 45532 - RNA, 1350 nt, Artificial Sequence
  neuraminidase__InfluenzaA__ABE97703
augaauccaaaucagaagauaauaaccaucggaucaaucuguaugguaacuggaauaguuagcuuaauguuacaaguugggaacaugaucucaauaugggucagucauucaauucacacagggaaucaacaccaagcugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaaacacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaacuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacugugggcuggucuuggccagacggugcugaguugccauucaccauugacaaguag

SEQ ID NO: 45533 - RNA, 1350 nt, Artificial Sequence
  neuraminidase__InfluenzaA__ABE97705
augaauccaaaucagaagauaauaaccaucggaucaaucuguaugguaacuggaauaguuagcuuaauguuacaaguugggaacaugaucucaauaugggucagucauucaauucacacagggaaucaacaccaagcugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaaacacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugauggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaacuuggaguaucaaauaggauauauaugcagugggguuuucggagacaauccacgccccaaugauggaacagguaguugugguccgguguccucuaacggggcauaugggguaaaaggguucucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45534 - RNA, 1350 nt, Artificial Sequence
  neuraminidase__InfluenzaA__ABE97706
augaauccaaaucagaagauaauaaccaucggaucaaucuguaugguaacuggaauaguuagcuuaauguuacaaguugggaacaugaucucacuaugggucagucauucaauucacacagggaaucaacaccaagcugaaccaaucagcaauacuaauuuucuuacugagagagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaaacacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugacggaccaaguaauggccaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaacuuggaguaucaaauaggauauauaugcaguggaguuuucggagacaauccacgccccaaugauggaacagguaguugugguccgguguccuccaacggggcauaugggguaaaaggguuuucauuuaaauacggcaauggugucuggaucgggagaaccaaaagcacuaguuccaggagcggcuuugaaaugauuugggauccaaauggguggacugaaacggacaguagcuuuucagugaaacaagauaucguagcaauaacugauuggucaggauauagcgggaguuuuguccagcauccagaacugacagggcuagauugcauaagaccuugcuucuggguugaguugaucagagggcggcccaaagagagcacaauuugggcuagugggagcagcauaucuuuuugugguguaaauagugacacuguggguuggucuuggccagacggugcugaguugccauucaccauugacaaguag

SEQ ID NO: 45535 - RNA, 1350 nt, Artificial Sequence
  neuraminidase__InfluenzaA__ABE97707
augaauccaaaucagaagauaauaaccaucggaucaaucuguaugguaacuggaauaguuagcuuaauguuacaaguugggaacaugaucucaauaugggucagucauucaauucacacagggaaucaacaccaagcugaaccaaucagcaauacuaauuuucuuacugagaaagcuguggcuucaguaaaauuagcgggcaauucaucucuuugccccauuaaaggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaaacacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaggagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaacuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45536 - RNA, 1350 nt, Artificial Sequence
  neuraminidase__InfluenzaA__ABE97708
augaauccaaaucagaagauaauaaccaucggaucaaucuguaugguaacuggaauaguuagcuuaauguuacaaguugggaacaugaucucaauaugggucagucauucaauucacacagggaaucaacaccaagcugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucacggagccuugcugaaugacaaacacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaaugaaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaacuuggaguaucaaauaggauauauaugcaguggaguuuucggggacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcaucccgaacugacagggcuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45537 - RNA, 1350 nt, Artificial Sequence
  neuraminidase__InfluenzaA__ABE97710
augaauccaaaucagaagauaauaaccaucggaucaaucuguaugguaacuggaauaguuagcuuaauguuacaaguugggaacaugaucucaauaugggucagucauucaauucacacagggaaucaacaccaagcugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaaacacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugauggaccaaguaauggucaggcaucacauaagaucuucaaaauggaaaaagggaaagugguuaaaucagucgaauugaaugcuccuaauuaucacuaugaggaaugcuccuguuauccugaugccggcgaaaucacaugugugugcagggauaauuggcauggcucaaaucggccauggguaucuuucaaucaaaacuuggaguaucaaauaggauauauaugcagugggguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucauugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45538 - RNA, 1350 nt, Artificial Sequence
  neuraminidase__InfluenzaA__ABE97711
augaauccaaaucagaagauaauaaccaucggaucaaucuguaugguaacuggaauaguuagcuuaauguuacaaguugggaacaugaucucaauaugggucagucauucaauucacacagggaaucaacaccaagcugaaccaaucagcaauacuaauuuucuuacugagaaagcuguggcuucaguaaaauuagcgggcaauucaucucuuugccccauuaacggaugggcuguauacaguaaggacaacaguauaaggauugguuccaagggggauguguuuguuauaagagagccguucaucucaugcucccacuuggaaugcagaacuuucuuuuugacucagggagccuugcugaaugacaaacacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugacggaccaagugauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaacuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugguuugggauccaaauggguggacugaaacggacaguagcuuuucagugaaacaagauaucguggcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45539 - RNA, 1350 nt, Artificial Sequence
  neuraminidase__InfluenzaA__ABE97712
augaauccaaaucagaagauaauaaccaucggaucaaucuguaugguaacuggaauaguuagcuuaauguuacaaguugggaacaugaucucaauaugggucagucauucaauucacacagggaaucaacaccaagcugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaaacacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaacuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45540 - RNA, 1350 nt, Artificial Sequence; identical to SEQ ID NO: 45539
  neuraminidase__InfluenzaA__ABE97713

SEQ ID NO: 45541 - RNA, 1350 nt, Artificial Sequence
  neuraminidase__InfluenzaA__ABE97715
augaauccaaaucagaagauaauaaccaucggaucaaucuguaugguaacuggaauaguuagcuuaauguuacaaguugggaacaugaucucaauaugggucagucauucaauucacacagggaaucaacaccaagcugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaaacacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaacuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuugcuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45542 - RNA, 1350 nt, Artificial Sequence
  neuraminidase__InfluenzaA__ABE97717
augaauccaaaucagaagauaauaaccaucggaucaaucuguaugguaacuggaauaguuaacuuaauguuacaaguugggaacaugaucucaauaugggucagucauucaauucacacagggaaucaacaccaagcugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaaacacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaacuuggaguaucaaauaggauauauaugcaguggaguuuucggagacaauccacgccccaaugauggaacagguaguugugguccggugcccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45543 - RNA, 1350 nt, Artificial Sequence
  neuraminidase__InfluenzaA__ABE97718
augaauccaaaucagaagauaauaaccaucggaucaaucuguaugguaacuggaauaguuagcuuaauguuacaaguugggaacaugaucucaauaugggucagucauucaauucacacagggaaucaacaccaagcugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaauggaaaaagggaaagugguuaaaucggucgaauuggaugcuccuaauuaucacuaugaggaaugcuccuguuauccugaugccggcgaaaucacaugugugugcagggauaauuggcauggcucaaaucggccauggguaucuuucaaucaaaacuuggaguaucaaauaggauauauaugcaguggaguuuucggggacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguucagcauccagaacugacaggacuagauugcauaagaccuuguuucuggguugaguugaucagagggcgacccaaagagagcacaauuuggacuagugggagcagcauaucuuuuugugguguagauagugacacuguggguuggucuuggccagacggugcugaguugccauucaccauugacaaguag

SEQ ID NO: 45544 - RNA, 1350 nt, Artificial Sequence
  neuraminidase__InfluenzaA__ABE97719
augaauccaaaucagaagauaauaaccaucggaucaaucuguaugguaacuggaauaguuagcuuaauguuacaaguugggaacaugaucucaauaugggucagucauucaauucacacagggaaucaacaccaagcugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaaacacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaaugaaaaaaggaaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcaucccgaacugacagggcuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45545 - RNA, 1350 nt, Artificial Sequence
  neuraminidase__InfluenzaA__ABE97720
augaauccaaaucagaagauaauaaccaucggaucaaucuguaugguaacuggaauaguuagcuuaauguuacaaguugggaacaugaucucaauaugggucagucauucaauucacacagggaaucaacaccaagcugaaccaaucagcaaugcuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaaacacuccaaugggacugucaaagacagaagcccucacagaacacuaaugaguuguccugugggugaggcucccuccccauauaacucaagguuugagucuguugcuuggucagcaagugcuugccaugauggcaccaguugguugacaauuggaauuucuggcccagacaauggggcuguagcuguauugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcaugguucaaaucggccguggguaucuuucaaucaaaacuuggaguaucaaauaggauauauaugcaguggaguuuucggagacacuccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45546 - RNA, 1410 nt, Artificial Sequence
  neuraminidase__InfluenzaA__ABF47553
augaauccaaaucaaaagauaauaacaauuggcucuguuucucucaccauugccacaauaugcuuccuuaugcaaauugccauucugguaacuacuguaacauugcauuucaagcaauaugagugcagcucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuugggcagggaaccacacuaaacaacaggcauucaaaugacacaguacaugauaggaccccuuaucgaacccucuugaugaaugaguuggguguuccauuucauuugggaaccaagcaggugugcauagcaugguccagcucaaguugucacgauggaaaagcaugguugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagauccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaagggaacaggaaacuagagucugguggaccucaaacaguauuguuguguuuuguggcaccucagguacauauggaacaggcucauggccugacggggcggacaucaaucucaugccuauauaa

SEQ ID NO: 45547 - RNA, 1413 nt, Artificial Sequence; identical to SEQ ID NO: 45389
  neuraminidase__InfluenzaA__ABF47564

SEQ ID NO: 45548 - RNA, 1413 nt, Artificial Sequence
  neuraminidase__InfluenzaA__ABF47575
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucaguggcauuggccggcaauucaucucuuuguucuaucaguggaugggcuauauacacaaaagacaacagcauaagaauugguuccaaaggagauguuuuugucauaagagagccuuucauaucauguucucacuuugaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45549 - RNA, 1413 nt, Artificial Sequence; identical to SEQ ID NO: 45389
  neuraminidase__InfluenzaA__ABF47586

SEQ ID NO: 45550 - RNA, 1410 nt, Artificial Sequence; identical to SEQ ID NO: 45360
  neuraminidase__InfluenzaA__ABF47597

SEQ ID NO: 45551 - RNA, 1413 nt, Artificial Sequence
  neuraminidase__InfluenzaA__ABF47608
augaauccaaaucaaaaaauaauaaccauuggaucaaucaguauugcaauuggaauaauuagucugauauugcaaauaggaaauauuauuucaauaugggcuagccacucaauccaaacuggaagucaaaaccacacuggaauaugcaaccaaagaaucauuacauaugaaaauagcaccuggguaaaucaaacauauguuaauauuaacaacacuaauguuguugcuggaaaggacaaaaccucaaugacauuggccggcaauucaucucuuugcccuauccguggaugggcuauauacacaaaagacaacagcauaagaauugguuccaaaggagauguuuuugucauaagagagccuuuuauaucauguucucacuuggaauguagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaauuucugguccagauaauggggcaguggcuguacuaaaauacaacggcauaauaacugaaaccauuaaaaguuggaagaagcgaauauuaagaacacaagagucugaaugugucuguaugaacgguucauguuuuaccauaaugaccgauggcccgaguaauggggccgcaucguacagaaucuucaaaaucgagaaggggagaguuacuaaaucaauagaguuggaugcacccaauuaucauuacgaggaauguucauguuacccagacacuggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugaaacaggauaucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 45552 - RNA, 1410 nt, Artificial Sequence
  neuraminidase__InfluenzaA__ABF47619
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagagagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccucggacagggaacaacacuaaacaacaggcauucaaaugacacaguacaugauaggaccccuuaucggacccuauugaugaaugaguuggguguuccauuucauuugggaaccaagcaaguaugcauagcaugguccaguucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccacugucaggaagugcucaacaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcgccagcaguagccauugccugaauccuaacaaugaggaagggggucauggagugaaaggcugggccuuugaugauggaaaugauguguggaugggaagaacgaucagugagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45553 - RNA, 1413 nt, Artificial Sequence
  neuraminidase__InfluenzaA__ABF47630
augaauccaaaucaaaaaauaauaaccauuggaucaaucaguauugcaauuggaauaauuagucugauauugcaaauaggaaauaucauuucaauaugggcuagccacucaauccaaacuggaagucaaaaccacacuggaauaugcaaccaaagaaucauuacauaugaaaauagcaccuggguaaaucaaacauauguuaauauuaacaacacuaauguuguugcuggaaaggacaaaaccucaauggcauuggccggcaauucaucucuuugcccuauccguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaauuucugguccagauaauggggcaguggcuguacuaaaauacaacggcauaauaacugaaaccauuaaaaguuggaagaagcgaauauuaagaacacaagagucugaaugugucuguaugaacgguucauguuuuaccauaaugaccgauggcccgaguaauggggccgcaucguacagaaucuucaaaaucgagaaggggagaguuacuaaaucaauagaguuggaugcacccaauuaucauuacgaggaauguucauguuacccagacaccggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugaaacaggauaucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 45554 - RNA, 1413 nt, Artificial Sequence
  neuraminidase__InfluenzaA__ABF47652
augaauccaaaucaaaaaauaauaaccauuggaucaaucaguauugcaauuggaauaauuagucugauauugcaaauaggaaauauuauuucaauaugggcuagccacucaauccaaacuggaagucaaaaccacacuggaauaugcaaccaaagaaucauuacauaugaaaauagcaccuggguaaaucaaacauauguuaauauuaacaacacuaauguuguugcaggaaaggacaaaaccucaaugacauuggccggcaauucaucucuuugcccuauccguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaauuucugguccagauaauggggcaguggcuguacuaaaauacaacggcauaauaacugaaaccauuaaaaguuggaagaagcgaauauuaagaacacaagagucugaaugugucuguaugaacgguucauguuuuaccauaaugaccgauggcccgaguaauggggccgcaucguacagaaucuucaaaaucgagaaggggagaguuacuaaaucaauagaguuggaugcacccaauuaucauuacgaggaauguucauguuacccaaacacuggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugaaacaggauaucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 45555 - RNA, 1413 nt, Artificial Sequence
  neuraminidase__InfluenzaA__ABF47663
augaauccaaaucaaaaaauaauaaccauuggaucaaucaguauugcaauuggaauaauuagucugauauugcaaauaggaaauauuauuucaauaugggcuagccacucaauccaaacuggaagucaaaaccacacuggaauaugcaaccaaagaaucauuacauaugaaaauagcaccuggguaaaucaaacauauguuaauauuaacaacacuaauguuguugcuggaaaggacaaaaccucaaugacauuggccggcaauucaucucuuugcccuauccguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaauuucugguccagauaauggggcaguggcuguacuaaaauacaacggcauaauaacugaaaccauuaaaaguuggaagaagcgaauauuaagaacacaagagucugaaugugucuguaugaacgguucauguuuuaccauaaugaccgauggcccgaguaauggggccgcaucguacagaaucuucaaaaucgagaaggggagaguuacuaaaucaauagaguuggaugcacccaauuaucauuacgaggaauguucauguuacccagacaccggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauauggcaaugguguuuggauaggaaggacuaaaaguaacagacucagaaagggauuugagaugauuugggauccuaauggauggacagauaccgacagugauuucucaaugaaacaggauaucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 45556 - RNA, 1413 nt, Artificial Sequence
  neuraminidase__InfluenzaA__ABF47674
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcauccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45557 - RNA, 1413 nt, Artificial Sequence; identical to SEQ ID NO: 45455
  neuraminidase__InfluenzaA__ABF47696

SEQ ID NO: 45558 - RNA, 1413 nt, Artificial Sequence
  neuraminidase__InfluenzaA__ABF47707
augaauccaaaucagaaaauaauaaccauuggaucaaucuguauggcaaucggaauaauuagucuaauauugcaaauagggaauauuaucucaauauggguuagccacucaauucaaacuggaagucaaaaccauacaggaauaugcaaccaaagaaucauuaccuaugaaaauagcaccuggguaaaucaaacauauguuaauauuagcaacacuaacguuguugcuggaaagggcacaacuucaaugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggcgcucuauuaaaugacaagcauucaaaugggaccguuaaggacagaagcccuuauagggccuuaaugagcuguccuauaggugaagcuccgucuccauacaauucaagguuugaaucgguugcuuggucagcaagugcaugucacgauggcaugggcuggcuaacaaucggaauuucugguccagaugauggagcaguggcuguacuaaaauacaacggcauaauaacugaaaccauaaaaaguuggaggaagcaaauauuaagaacacaagagucugaaugugucuguguaaacgguucauguuuuaccauaaugaccgauggcccgagugaugggccggccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcaguugugauccaguaaauguugauggagcagacggaguaaagggguuuucauacagauaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgacccagagaaaaaacaacaaucuggacuagugggagcagcauuucuuuuuguggcgugaauagugauacuguaaauuggucuuggccagacggugccgaguugccauucaccauugacaaguag

SEQ ID NO: 45559 - RNA, 1413 nt, Artificial Sequence
  neuraminidase__InfluenzaA__ABF47718
augaauccaaaucagaaaauaauaaccauuggaucaaucuguauggcaaucggaauaauuagucuaauauugcaaauagggaauauuaucucaauauggguuagccacucaauucaaacuggaagucaaaaccauacaggaauaugcaaccaaagaaucauuaccuaugaaaauagcaccuggguaaaucaaacauauguuaauauuagcaacacuaacguuguugcuggaaaggacacaacuucaaugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggcgcucuauuaaaugacaagcauucaaaugggaccguuaaggacagaagcccuuauagggccuuaaugagcuguccuauaggugaagcuccgucuccauacaauucaagguuugaaucgguugcuuggucagcaagugcaugucacgauggcaugggcuggcuaacaaucggaauuucugguccagaugauggagcaguggcuguacuaaaauacaacggcauaauaacugaaaccauaaaaaguuggaggaagcaaauauuaagaacacaagagucugaaugugucuguguaaacgguucauguuuuaccauaaugaccgauggcccgagugaugggccggccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcagcugugauccaguaaauguugauggagcagacggaguaaagggguuuucauacagguaugguaaugguguuuggauaggaaggacuaaaaguaacagcuccagaaagggauuugagaugauuugggacccuaauggcuggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgacccagagaaaaaacaacaaucuggacuagugggagcagcauuucuuucuguggcgugaauagugauacuguaaauuggucuuggccagacggugccgaguugccauucaccauugacaaguag

SEQ ID NO: 45560 - RNA, 1413 nt, Artificial Sequence; identical to SEQ ID NO: 45455
  neuraminidase__InfluenzaA__ABF47729

SEQ ID NO: 45561 - RNA, 1413 nt, Artificial Sequence
  neuraminidase__InfluenzaA__ABF47740
augaauccaaaucagaaaauaauaaccauuggaucaaucuguauggcaaucggaauaauuagucuaauauugcaaauagggaauauuaucucaauauggguuagccacucaauucaaacuggaagucaaaaccauacaggaauaugcaaccaaagaaucauuaccuaugaaaauagcaccuggguaaaucaaacauauguuaauauuagcaacacuaacguuguugcuggaaaggacacaacuucaaugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggcgcucuauuaaaugacaagcauucaaaugggaccguuaaggacagaagcccuuauagggccuuaaugagcuguccuauaggugaagcuccgucuccauacaauucaagguuugaaucgguugcuuggucagcaagugcaugucacgauggcaugggcuggcuaacaaucggaauuucugguccagaugauggagcaguggcuguacuaaaauacaacggcauaauaacugaaaccauaaaaaguuggaggaagcaaauauuaagaacacaagagucugaaugugucuguguaaacgguucauguuuuaccauaaugaccgauggcccgagugaugggccggccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagaugggaaaggcaguugugauccaguaaauguugauggagcagacggaguaaagggguuuucauacagauaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgacccagagaaaaaacaacaaucuggacuagugggagcagcauuucuuuuuguggcgugaauagugauacuguaaauuggucuuggccagacggugccgaguugccauucaccauugacaaguag

SEQ ID NO: 45562 - RNA, 1413 nt, Artificial Sequence
  neuraminidase__InfluenzaA__ABF47751
augaauccaaaucagaaaauaauaaccauuggaucaaucuguauggcaaucggaauaauuagucuaauauugcaaauaggaaauauuauuucaauauggguuagccacucaauccaaacuggaagucaaaaccacacuggaauaugcaaccaaagaaucauuaccuaugaaaauagcaccuggguaaaucaaacauauguuaauauuaacaacacuaacguuguugcuggaaaggacacaacuucagugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacucaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcaugggcuggcuaacaaucggaauuucugguccagaugauggagcaguggcuguacuaaaauacaacggcauaauaacugaaaccauaaaaaguuggaggaagcgaauauuaagaacacaagagucugaaugugucuguguaaacgguucauguuuuaccauaaugaccgauggcccgaguaaugggccugccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcagcugugauccaguaacuguugauggagcagacggaguaaagggguuuucauacagguauggcaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgaccuagagaaaagacaacaaucuggacuagugggagcagcauuucuuuuuguggcgugaauagugauacugcaaauuggucuuggccagacggugccgaguugccauucaccauugacaaguag

SEQ ID NO: 45563 - RNA, 1413 nt, Artificial Sequence
  neuraminidase__InfluenzaA__ABF47773
augaauccaaaucagaaaauaauaaccauuggaucaaucuguaugacaaucggaauaauuagucuaauauugcaaauaggaaauauuauuucaauauggguuagccacucaauccaaacuggaagucaaaaccacacuggaauaugcaaccaaagaaucauuaccuaugaaaauagcaccuggguaaaucaaacauaugucaauauuaacaacacuaacguuguugcuggaaaggacacaacuucagugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcaugggcuggcuaacaaucggaauuucugguccagaugauggagcaguggcuguacuaaaauacaacggcauaauaacugaaaccauaaaaaguuggaggaagcgaauauuaagaacacaagagucugaaugugucuguguaaacgguucauguuuuaccauaaugaccgauggcccgaguaauggaccugccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguguucggugacaauccgcgucccaaagauggaaaaggcagcugugauccaguaacuguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgaccuagagaaaagacaacaaucuggacuagugggagcagcauuucuuuuuguggcgugaauagugauacugcaaauuggucuuggccagacggugccgaguugccauucaccauugacaaguag

SEQ ID NO: 45564 - RNA, 1413 nt, Artificial Sequence; identical to SEQ ID NO: 45563
  neuraminidase__InfluenzaA__ABF47784

SEQ ID NO: 45565 - RNA, 1413 nt, Artificial Sequence; identical to SEQ ID NO: 45563
  neuraminidase__InfluenzaA__ABF47795

SEQ ID NO: 45566 - RNA, 1413 nt, Artificial Sequence
  neuraminidase__InfluenzaA__ABF47806
augaauccaaaucagaaaauaauaaccauuggaucaaucuguaugacaaucggaauaauuagucuaauauugcaaauaggaaauauuauuucaauauggguuagccacucaauccaaacuggaagucaaaaccacacuggaauaugcaaccaaagaaucauuaccuaugaaaauagcaccuggguaaaucaaacauaugucaauauuaacaacacuaacguuguugcuggaaaggacacaacuucagugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcaugggcuggcuaacaaucggaauuucugguccagaugauggagcaguggcuguacuaaaauacaacggcauaauaacugaaaccauaaaaaguuggaggaagcgaauauuaagaacacaagagucugaaugugucuguguaaacgguucauguuuuaccauaaugaccgauggcccgaguaauggaccugccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguguucggugacaauccgcgucccaaagauggaaaaggcagcugugauccaguaacuguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugaacuaacaggauuggacuguaugaggccuugcuucuggguugaauuaaucagaggacgaccuagagaaaagacaacaaucuggacuagugggagcagcauuucuuuuuguggcgugaauagugauacugcaaauuggucuuggccagacggugccgaguugccauucaccauugacaaguag

SEQ ID NO: 45567 - RNA, 1413 nt, Artificial Sequence
  neuraminidase__InfluenzaA__ABF47817
augaauccaaaucagaaaauaauaaccauuggaucaaucuguaugacaaucggaauaauuagucuaauauugcaaauaggaaauauuauuucaauauggguuagccacucaauccaaacuggaagucaaaaccacacuggaauaugcaaccaaagaaucauuaccuaugaaaauagcaccuggguaaaucaaacauaugucaauauuaacaacacuaacguuguugcuggaaaggacacaacuucagugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcaugggcuggcuaacaaucggaauuucugguccagaugauggagcaguggcuguacuaaaauacaacggcauaauaacugaaaccauaaaaaguuggaggaagcgaauauuaagaacacaagagucugaaugugucuguguaaacgguucauguuuuaccauaaugaccgauggcccgaguaauggaccugccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguguucggugacaauccgcgucccaaagauggaaaaggcagcugugauccaguaacuguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgaccuagagaaaagacaacaaucuggacuagugggagcagcauuucuuuuuguggcguaaauagugauacugcaaauuggucuuggccagacggugccgaguugccauucaccauugacaaguag

SEQ ID NO: 45568 - RNA, 1413 nt, Artificial Sequence; identical to SEQ ID NO: 45563
  neuraminidase__InfluenzaA__ABF47839

SEQ ID NO: 45569 - RNA, 1413 nt, Artificial Sequence; identical to SEQ ID NO: 45563
  neuraminidase__InfluenzaA__ABF47850

SEQ ID NO: 45570 - RNA, 1413 nt, Artificial Sequence; identical to SEQ ID NO: 45332
  neuraminidase__InfluenzaA__ABF47872

SEQ ID NO: 45571 - RNA, 1413 nt, Artificial Sequence; identical to SEQ ID NO: 45332
  neuraminidase__InfluenzaA__ABF47883

SEQ ID NO: 45572 - RNA, 1413 nt, Artificial Sequence; identical to SEQ ID NO: 45332
  neuraminidase__InfluenzaA__ABF47894

SEQ ID NO: 45573 - RNA, 1410 nt, Artificial Sequence; identical to SEQ ID NO: 45348
  neuraminidase__InfluenzaA__ABF47905

SEQ ID NO: 45574 - RNA, 1362 nt, Artificial Sequence
  neuraminidase__InfluenzaA__ABF47958
augaauccaaaccagaaaauaauaaccauugggucaaucuguaugguagucggaauaauuagccuaauauugcaaauaggaaauauaaucucaauauggauuagccauucaauucaaaccggaaaucaaaaccauacuggaauaugcaaccaaggcagcauuaccuauaaaguuguugcugggcaggacucaacuucagugauauuaaccggcaauucaucucuuugucccauccgugggugggcuauacacagcaaagacaauggcauaagaauugguuccaaaggagacguuuuugucauaagagagccuuuuauuucauguucucacuuggaaugcaggaccuuuuuucugacucaaggcgccuuacugaaugacaagcauucaagggggaccuuuaaggacagaagcccuuauagggccuuaaugagcugcccugucggugaagcuccguccccguacaauucaagguuugaaucgguugcuuggucagcaagugcaugucaugauggaaugggcuggcuaacaaucggaauuucugguccagaugauggagcaguggcuguauuaaaauacaacggcauaauaacugaaaccauaaaaaguuggaggaagaauauauugagaacacaagagucugaauguaccuguguaaaugguucauguuuuaccauaaugaccgauggcccaagugaugggcuggccucguacaaaauuuucaagaucgagaaggggaagguuacuaaaucaauagaguugaaugcaccuaauucucacuacgaggaauguuccuguuacccugauaccggcaaagugaugugugugugcagagacaauuggcacgguucgaaccgaccauggguguccuucgaccaaaaccuagauuauaaaauaggauacaucugcagugggguuuucggugacaacccgcgucccaaagauggaacaggcagcuguggcccagugucugcugauggagcaaacggaguaaagggauuuucauauaaguaugguaaugguguuuggauaggaaggacuaaaagugacaguuccagacauggguuugagaugauuugggauccuaauggauggacagagacugauaguagguucucuaugagacaagauguuguggcaaugacugaucggucaggguacagcggaaguuucguucaacauccugagcuaacagggcuagacuguaugaggccuugcuucuggguugaauuaaucagggggcuaccugaggaggacgcaaucuggacuagugggagcaucauuucuuuuuguggugugaauagugauacuguagauuggucuuggccagacggugcugaguugccguucaccauugacaaguaa

SEQ ID NO: 45575 - RNA, 1350 nt, Artificial Sequence
  neuraminidase__InfluenzaA__ABF56651
augaauccaaaucagaagauaauaaccaucggaucaaucuguaugguaacuggaauaguuagcuuaauguuacaaguugggaacaugaucucaauaugggucagucauucaauucacacagggagucaacaccaagcugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaaacacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaacuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 45576 - RNA, 1410 nt, Artificial Sequence; identical to SEQ ID NO: 45331
  neuraminidase__InfluenzaA__ABF82654

SEQ ID NO: 45577 - RNA, 1413 nt, Artificial Sequence; identical to SEQ ID NO: 45389
  neuraminidase__InfluenzaA__ABF82665

SEQ ID NO: 45578 - RNA, 1413 nt, Artificial Sequence; identical to SEQ ID NO: 45445
  neuraminidase__InfluenzaA__ABF82676

SEQ ID NO: 45579 - RNA, 1413 nt, Artificial Sequence
  neuraminidase__InfluenzaA__ABF82687
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagacuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccaguaacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauugaacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45580 - RNA, 1410 nt, Artificial Sequence
  neuraminidase__InfluenzaA__ABF82698
augaauccaaaucaaaagauaauaacaauuggcucuguuucucucacuauuaccacaauaugcuuccuuaugcaaauugccauccugguaauuacuguaacauugcauuucaagcaaugugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacacgauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcgaguuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccuggauccuaacaaugaggaagggggucauggagugaaaggcugggccuuugaugauggaaaugauguguggaugggaagaacgaucagugagaaguuacgcucagguuaugaaaccuucaaagucauuggaggcugguccaagccuaacuccaaauugcagauaaauaggcaagucauaguugacaaagguaauagguccgguuauucugguauuuucucuguugaaggcaaaagcugcaccaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45581 - RNA, 1410 nt, Artificial Sequence
  neuraminidase__InfluenzaA__ABF82709
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuugcaucaauggaacuuguacaguaguaaugacugaugggagugcuucaggaagagcugauacuaaaauacuauucauugaggaggggaaaaucguucauauuagcccauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuugucggagacacacccagaaaaaacgacagcuccagcaguagccauugccugaauccuaacaaugaggaagggggucauggaguaaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucgaugcuuuuauguggaguugauaaggggaaggaaacaggaaacugaagucugguggaccucaaacaguauuguuguguuuuguggcacaucagguacauauggaacaggcucauggccugauggggcggacaucaaucucaugccuauauaa

SEQ ID NO: 45582 - RNA, 1413 nt, Artificial Sequence
  neuraminidase__InfluenzaA__ABF82822
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguuaauagugauacugcaaacuggucuuggccagacggugcugaguugccguucaccauugacaaguag

SEQ ID NO: 45583 - RNA, 1413 nt, Artificial Sequence; identical to SEQ ID NO: 45389
  neuraminidase__InfluenzaA__ABF82833

SEQ ID NO: 45584 - RNA, 1413 nt, Artificial Sequence; identical to SEQ ID NO: 45389
  neuraminidase__InfluenzaA__ABF82844

SEQ ID NO: 45585 - RNA, 1413 nt, Artificial Sequence
  neuraminidase__InfluenzaA__ABF82855
augaauccaaaucaaaaaauaauaaccauuggaucaaucaguauagcaaucggaauaauuagccuaauguugcaaauaggaaacauuauuucaauaugggcuagucacucaauccaaauuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45586 - RNA, 1413 nt, Artificial Sequence; identical to SEQ ID NO: 45389
  neuraminidase__InfluenzaA__ABF82866

SEQ ID NO: 45587 - RNA, 1413 nt, Artificial Sequence
  neuraminidase__InfluenzaA__ABF82888
augaauccaaaucaaaaaauaauaaccauuggaucaaucaguauagcaaucggaaugauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagccccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45588 - RNA, 1413 nt, Artificial Sequence; identical to SEQ ID NO: 45389
  neuraminidase__InfluenzaA__ABF82910

SEQ ID NO: 45589 - RNA, 1413 nt, Artificial Sequence; identical to SEQ ID NO: 45389
  neuraminidase__InfluenzaA__ABF82921

SEQ ID NO: 45590 - RNA, 1413 nt, Artificial Sequence; identical to SEQ ID NO: 45389
  neuraminidase__InfluenzaA__ABF82932

SEQ ID NO: 45591 - RNA, 1413 nt, Artificial Sequence
  neuraminidase__InfluenzaA__ABF82943
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuaguuagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45592 - RNA, 1350 nt, Artificial Sequence
  neuraminidase__InfluenzaA__ABG20474
augaauccaaaucagaagauaauaaccaucggaucaaucuguaugguaauuggaauaguuagcuuaauguuacaaauugggaacaugaucucaauaugggucagucauucaauccagacagggaaucaacgccaagcugaaccaaucagcaauacuaaauuucuuacugagaaagcuguggcuucaguaacauuagcgggcaauucaucucuuugccccauuagcggaugggcuguauacaguaaggacaacaguauaaggaucgguuccaggggggauguguuuguuauaagagagccguucaucucaugcucccacuuggaaugcagaacuuucuuuuugacucagggagccuugcugaaugacaagcacuccaaugggacugucaaagacagaagcccuuacagaacauugaugaguuguccugugggugaggcucccuccccauauaacucaagguuugagucuguugcuuggucagcaagugcuugccaugauggcaccaguugguugaccauuggaauuucugguccagacaauggggcuguggcuguauugaaauacaauggcauaauaacagacaccaucaagaguuggaggaacaacguacugagaacccaagagucugaaugugcauguguaaauggcucuugcuuuacuguaaugacugauggaccaaguaaugggcaggcaucauauaaaaucuucaaaauggaaaaagggaaagugguuaaaucagucgaauuggaugcuccuaauuaucacuaugaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugugguccgguguccccuaacggggcauaugggguaaaaggguuuucauuuaaauacggcaaugguguuuggauugggagaaccaaaagcacuaauuccaggagcggcuuugaaaugauuugggauccaaauggguggacuggaacggacaguaacuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccagugggagcagcauauuuuuuugugguguaaauagugacacuguuaguuggucuuggccagacggugcugaguugccauucaccauugacaaguag

SEQ ID NO: 45593 - RNA, 1410 nt, Artificial Sequence; identical to SEQ ID NO: 45416
  neuraminidase__InfluenzaA__ABG26761

SEQ ID NO: 45594 - RNA, 1410 nt, Artificial Sequence
  neuraminidase__InfluenzaA__ABG26772
augaauccaaaucaaaagauaauaacgauuggcucuguuucucucacuauugccacaauauguuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauuaaggaggggaaaaucguucauauuagcccauugucaggaagugcucaacaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuucuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45595 - RNA, 1413 nt, Artificial Sequence
  neuraminidase__InfluenzaA__ABG26783
augaauccaaaucaaaaaauaauaaccauuggaucaaucaguauugcaauuggaauaauuagucugauauugcaaauaggaaauauuauuucaauaugggcuagccacucaauccaaacuggaagucaaaaccacacuggaauaugcaaccaaagaaucauuacauaugaaaauagcaccuggguaaaucaaacauauguuaauauuaacaacacuaauguuguugcaggaaaggacaaaaccucaaugacauuggccggcaauucaucucuuugcccuauccguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaauuucugguccagauaauggggcaguggcuguacuaaaauacaacggcauaauaacugaaaccauuaaaaguuggaagaagcgaauauuaagaacacaagagucugaaugugucuguaugaacgguucauguuuuaccauaaugaccgauggcccgaguaauggggccgcaucguacagaaucuucaaaaucgagaaggggagaguuacuaaaucaauagaguuggaugcacccaauuaucauuacgaggaauguucauguuacccaaacacuggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugaaacaggauaucguggcaaugacugauuggucaggguacagcggaaguuuuguucaacauccugagcuaacaggauuggacuguauaagaccuugcuucuggguugaauuagucagagggcuaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 45596 - RNA, 1413 nt, Artificial Sequence; identical to SEQ ID NO: 45472
  neuraminidase__InfluenzaA__ABG26794

SEQ ID NO: 45597 - RNA, 1410 nt, Artificial Sequence
  neuraminidase__InfluenzaA__ABG26805
augaauccaaaucaaaagauaauaacaauuggcucuguuucucucaccauugcaacaauaugcuuccuuacgcaaauugccauccugguaacuacuguaacauugcauuucaagcaauaugagugcagcucccccccaaacaaccaaguaaugccgugugaaccaauaauaauagaaagaaacauaacagagauaguguauuugacuaacaccaccauagagaaagagauaugccccaaacuaguggaauacagaaauuggucaaagccgcaauguaaaauuacaggauuugcaccuuuuucuaaggacaauucaauucggcuuuccgcuggcggggacauuugggugacgagagaaccuuaugugucaugcgauccuggcaaguguuaucaauuugcacucgggcagggaaccacacuaaacaacaagcauucaaaugacacaauacaugauaggaccccuuaucgaacccuauugaugaaugaguuggguguuccauuucauuugggaaccaagcaagugugcauagcaugguccagcucaaguugucacgauggaaaagcauggcugcauguuuguaucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggaguguuccuguuauccucgauauccuggugucagaugugucugcagagacaacuggaaaggcuccaauaggcccaucguagauauaaauguaaaagauuauagcauuguuuccaguuaugugugcucagggcuuguuggcgacacacccagaaaaaacgacagauccagcaguagcuauugccggaauccuaacaaugagaaagggaaucauggagugaaaggcugggccuuugacgauggaaaugacguguggaugggaagaacgauuggcgaggaguuacgcucagguuaugaaaccuuuaaagucauuggugguugguccacaccuaacuccaaauugcagauaaauaggcaaaucauaguugacagcgguaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcaccucagguacauauggaacaggcucauggccugauggagcggacaucaaucucaugccuauauaa

SEQ ID NO: 45598 - RNA, 1413 nt, Artificial Sequence; identical to SEQ ID NO: 45455
  neuraminidase__InfluenzaA__ABG26816

SEQ ID NO: 45599 - RNA, 1413 nt, Artificial Sequence; identical to SEQ ID NO: 45563
  neuraminidase__InfluenzaA__ABG26827

SEQ ID NO: 45600 - RNA, 1413 nt, Artificial Sequence; identical to SEQ ID NO: 45563
  neuraminidase__InfluenzaA__ABG26838

SEQ ID NO: 45601 - RNA, 1410 nt, Artificial Sequence
  neuraminidase__InfluenzaA__ABG26860
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuggcagaauacagaaauuggucaaagccgcaauguaaaauuacaggauuugcaccuuuuucuaaggacaauucaauccggcuuuccgcggguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcgugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagacagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucauagauauaaaugugaaagauuauagcauuguuuccaguuaugugugcucaggacuuguuggagacacacccagaaaaaacgacagcuccagcaguagcuauugcuggaauccuaacaaugagaaagggggucauggagugaaaggcugggccuuugaugauggaaaugacguguggaugggaagaacgaucagcgaggagucacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45602 - RNA, 1410 nt, Artificial Sequence
  neuraminidase__InfluenzaA__ABG26871
augaauccaaaucaaaagauaauaacaauuggcucuguuucucucacuauugccacaauaugcuuccuuaugcaaauugccauccugguaacuacuguaacauugcauuucaagcaauaugagugcaacucccccccauacaaccaaauaaugcugugugaaccaacaauaauagaaagaaacauaacagagauaguguaucugaccaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcgugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagacagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugcuggaauccuaacaaugagaaagggggucauggagugaaaggcugggccuuugaugauggaaaugacguguggaugggaagaacgaucagcgaggagucacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45603 - RNA, 1410 nt, Artificial Sequence
  neuraminidase__InfluenzaA__ABG26893
augaauccaaaucaaaagauaauaacaauuggcucuauuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcgugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagacagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugcuggaauccuaacaaugagaaagggggucauggagugaaaggcugggccuuugaugauggaaaugacguguggaugggaagaacgaucagcgaggagucacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45604 - RNA, 1410 nt, Artificial Sequence
  neuraminidase__InfluenzaA__ABG26915
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauuaguucaugguccaaaaauauccucagaacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccugaauccuaacaaugaggaagggggucauggagugaaaggcugggccuuugaugauggaaaugacguguggaugggaagaacgaucagcgaaaaguuacgcucagguuaugaaaccuucaaggucauuggaggcugguccaaaccuaacuccaaauugcagauaaauaggcaagucauaguugacagagguaauagguccgguuauucugguauuuucucuguugaaggcaaaagcugcgucaaucggugcuuuuauguggaguugauaaggggaaggaaacaggaaacugaagucugguggaccucaaacaguauuguuguguuuuguggcaccucagguacauauggaacaggcucauggccugauggagcggacaucaaucucaugccuauauaa

SEQ ID NO: 45605 - RNA, 1410 nt, Artificial Sequence
  neuraminidase__InfluenzaA__ABG26937
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagacaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagggguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45606 - RNA, 1413 nt, Artificial Sequence; identical to SEQ ID NO: 45389
  neuraminidase__InfluenzaA__ABG26948

SEQ ID NO: 45607 - RNA, 1410 nt, Artificial Sequence
  neuraminidase__InfluenzaA__ABG26959
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgacggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45608 - RNA, 1413 nt, Artificial Sequence
  neuraminidase__InfluenzaA__ABG37123
augaauccaaaucaaaaaauaauaaccauuggaucaaucaguauaacaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45609 - RNA, 1410 nt, Artificial Sequence
  neuraminidase__InfluenzaA__ABG37134
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaagggaaaaucguucauauuagccaauuguuaggaagugcucagcaugucgaagagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauugaaggcugguccaaacccaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45610 - RNA, 1410 nt, Artificial Sequence
  neuraminidase__InfluenzaA__ABG37145
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaggcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagcccauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuugucggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcacaucagguacauauggaacaggcucauggccugauggggcggacaucaaucucaugccuauauaa

SEQ ID NO: 45611 - RNA, 1410 nt, Artificial Sequence
  neuraminidase__InfluenzaA__ABG37156
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagagagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccucggacagggaacaacacuaaacaacaggcauucaaaugacacaguacaugauaggaccccuuaucggacccuauugaugaaugaguuggguguuccauuucauuugggaaccaagcaaguaugcauagcaugguccaguucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccacugucaggaagugcucaacaugucgaggagugcuccuguuauccucgauauccuggugucagaugugucugcagagacaacuggaaaggcuccaauaggcccaucguagauauaaaugugaaagauuauagcauuguuuccaauuaugugugcucaggacuuguuggagacacacccagaaaaaacgacagcuccagcaguagccauugccugaauccuaacaaugaggaagggggucauggagugaaaggcugggccuuugaugauggaaaugauguguggaugggaagaacgaucagugagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45612 - RNA, 1410 nt, Artificial Sequence
  neuraminidase__InfluenzaA__ABG37167
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagaaaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucgugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauuaguucaugguccaaaaauauccucaggacccaggagucggaaugcguuuguaucaauggaacuuguacaguaguaaugacugauggaagugcuucaggaagagcugauacuaaaauacuauucauugaagaggggaaaauuguucauauuagcccauugucaggaagugcucagcaugucgaggagugcuccuguuauccucgauacccuggugucagaugugucugcagagacaacuggaaaggcuccaauaggcccaucguagauauaaaugugaaagauuauagcauuguuuccaguuaugugugcucaggacuuguuggagacacacccagaaaaaaugacagcuccagcaguagcuauugccugaauccuaacaaugaggaagggggucauggagugaaaggcugggccuuugaugauggaaaugacguguggaugggaagaacgaucagcgaaaaguuacgcucagguuaugaaaccuucaaggucauuggaggcugguccaaaccuaacuccaaauugcagauaaauaggcaagucauaguugacagagguaauagguccgguuauucugguauuuucucuguugaaggcaaaagcugcgucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45613 - RNA, 1410 nt, Artificial Sequence
  neuraminidase__InfluenzaA__ABG37189
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguauugcugugugaaccaacaauaauagagagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccucggacagggaacaacacuaaacaacaggcauucaaaugacacaguacacgauaggaccccuuaucggacccuauugaugaaugaguuggguguuccauuucauuugggaaccaagcaaguaugcauagcaugguccagcucaaguugucacgauggaaaagcauggcugcauguuuguguaacugggcaugaugaaaaugcaacugcuagcuucaucuacgaugggaggcuuguagauaguauugguucaugguccaaaaauauccucaggacccaggagucggaaugcguuuguaucaauggaacuuguacaguaguaaugacugacggaagugcuucaggaagagcugauacuaaaauacuauucauugaagaggggaaaaucguucauauuagcucacugucaggaagugcucagcaugucgaggagugcuccuguuauccucgauauccuggugucagaugcgucugcagagacaacuggaaaggcuccaauaggcccaucguagauauaaaugugaaagauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggagcggacaucaaucucaugccuauauaa

SEQ ID NO: 45614 - RNA, 1410 nt, Artificial Sequence
  neuraminidase__InfluenzaA__ABG37200
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagagagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauucuggcaaguguuaucaauuugcccucggacagggaacaacacuaaacaacaggcauucaaaugacacaguacaugauaggaccccuuaucggacccuauugaugaaugaguuggguguuccauuucauuugggaaccaagcaaguaugcauagcaugguccaguucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcacacugucaggaagugcucaacaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugauguguggaugggaagaacgaucagugagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45615 - RNA, 1410 nt, Artificial Sequence
  neuraminidase__InfluenzaA__ABG37211
augaauccaaaucaaaagauaauaacaauuggcucuguuucucucaccauugcaacaauaugcuuccuuacgcaaauugccauccugguaacuacuguaacauugcauuucaagcaauaugagugcagcucccccccaaacaaccaaguaaugccgugugaaccaauaauaauagaaagaaacauaacagagauaguguauuugacuaacaccaccauagagaaagagauaugccccaaacuaguggaauacagaaauuggucaaagccgcaauguaaaauuacaggauuugcaccuuuuucuaaggacaauucaauucggcuuuccgcuggcggggacauuugggugacgagagaaccuuaugugucaugcgauccuggcaaguguuaucaauuugcacucgggcagggaaccacacuaaacaacaagcauucaaaugacacaauacaugauaggaccccuuaucgaacccuauugaugaaugaguuggguguuccauuucauuugggaaccaagcaagugugcauagcaugguccagcucaaguugucacgauggaaaagcauggcugcauguuuguaucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggaguguuccuguuauccucgauauccuggugucagaugugucugcagagacaacuggaaaggcuccaauaggcccaucguagauauaaauguaaaagauuauagcauuguuuccaguuaugugugcucagggcuuguuggcgacacacccagaaaaaacgacagauccagcaguagcuauugccggaauccuaacaaugagaaagggaaucauggagugaaaggcugggccuuugacgauggaaaugacguguggaugggaagaacgauuggcgaggaguuacgcucagguuaugaaaccuuuaaagucauuggugguugguccacaccuaacuccaaauugcagauaaauaggcaagucauaguugacagcgguaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcaccucagguacauauggaacaggcucauggccugauggagcggacaucaaucucaugccuauauaa

SEQ ID NO: 45616 - RNA, 1410 nt, Artificial Sequence
  neuraminidase__InfluenzaA__ABG37233
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaagcaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacaauaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaauagcuauugccggaauccuaacaaugagaaagggagucauggagugaaagguugggccuuugaugauggaaaugacguguggaugggaagaacgaucagcgcggagucacgcucugguuaugaaaccuucaaaguuauuggaggcugguccaaaccuaacuccaaauugcagauaaauaggcaagucauaguugauagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45617 - RNA, 1410 nt, Artificial Sequence
  neuraminidase__InfluenzaA__ABG37244
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcgugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagacagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugcuggaauccuaacaaugagaaagggggucauggagugaaaggcugggccuuugaugauggaaaugacguguggaugggaagaacgaucagcgaggagucacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45618 - RNA, 1410 nt, Artificial Sequence; identical to SEQ ID NO: 45617
  neuraminidase__InfluenzaA__ABG37255

SEQ ID NO: 45619 - RNA, 1410 nt, Artificial Sequence
  neuraminidase__InfluenzaA__ABG37266
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauuaguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccugaauccuaacaaugaggaagggggucauggagugaaaggcugggccuuugaugauggaaaugacguguggaugggaagaacgaucagcgaaaaguuacgcucagguuaugaaaccuucaaggucauuggaggcugguccaaaccuaacuccaaauugcagauaaauaggcaagucauaguugacagagguaauagguccgguuauucugguauuuucucuguugaaggcaaaagcugcgucaaucggugcuuuuauguggaguugauaaggggaaggaaacaggaaacugaagucugguggaccucaaacaguauuguuguguuuuguggcaccucagguacauauggaacaggcucauggccugauggagcggacaucaaucucaugccuauauaa

SEQ ID NO: 45620 - RNA, 1410 nt, Artificial Sequence; identical to SEQ ID NO: 45617
  neuraminidase__InfluenzaA__ABG37277

SEQ ID NO: 45621 - RNA, 1410 nt, Artificial Sequence; identical to SEQ ID NO: 45617
  neuraminidase__InfluenzaA__ABG37288

SEQ ID NO: 45622 - RNA, 1410 nt, Artificial Sequence; identical to SEQ ID NO: 45617
  neuraminidase__InfluenzaA__ABG37310

SEQ ID NO: 45623 - RNA, 1410 nt, Artificial Sequence; identical to SEQ ID NO: 45619
  neuraminidase__InfluenzaA__ABG37321

SEQ ID NO: 45624 - RNA, 1410 nt, Artificial Sequence
  neuraminidase__InfluenzaA__ABG37332
augaauccaaaucaaaagauaauaacaauuggcucuguuucucucacuauugccacaauaugcuuccuuaugcaaauugccauccugguaacuacuguaacauugcauuucaagcaacaugagugcaacucccccccaaacaaccaaguaaugcugugugaaccaacaauaauagaaagaaacauaacagagauagugcaucugaccaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcgugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagacagagcugauacuaaaauacuauucauugaagaggggaaaaucguucauauuagcccauuaucaggaggugcucagcaugucgaggagugcuccuguuauccucgauacccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugcuggaauccuaacaaugagaaagggggucauggagugaaaggcugggccuuugaugauggaaaugacguguggaugggaagaacgaucagcgaggagucacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45625 - RNA, 1410 nt, Artificial Sequence
  neuraminidase__InfluenzaA__ABG37343
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcgugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagacagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaaaauuauagcauuguuuccaguuaugugugcucaggacuuguuggagacacacccagaaaaaacgacagcuccagcaguagcuauugcuggaauccuaacaaugagaaaggggggcauggagugaaaggcugggccuuugaugauggaaaugacguguggaugggaagaacgaucagcgaggagucacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45626 - RNA, 1410 nt, Artificial Sequence
  neuraminidase__InfluenzaA__ABG37354
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45627 - RNA, 1413 nt, Artificial Sequence
  neuraminidase__InfluenzaA__ABG37365
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuccauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 45628 - RNA, 1413 nt, Artificial Sequence; identical to SEQ ID NO: 45434
  neuraminidase__InfluenzaA__ABG37387

SEQ ID NO: 45629 - RNA, 1413 nt, Artificial Sequence
  neuraminidase__InfluenzaA__ABG37398
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacaacaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucauacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45630 - RNA, 1410 nt, Artificial Sequence
  neuraminidase__InfluenzaA__ABG37409
augaauccaaaucaaaagauaauaacgauuggcucuguuucucucaccauugccacaauaugcuuccuuaugcaaauugucauccugguaacuacuguaacauugcauuucaagcaauaugaaugcaacucccccccaaacaaccaagugaugccgugugaaccaacaauaauagaaagaaacauaacagagauaguguaucugaccaacaccaccauagagaaggaaauaugccccaaacuagcagaauacagaaauuggucaaagccgcaauguaacauuacuggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggugaugaugaaaaugcaacugcuagcuucauuuacaaugggaggcuuguagauaguauagguucaugguccaaaaaaauccucaggacccaggagucggaaugcguuuguaucaauggaacuuguacaguaguaaugacugauggaagugcuucaggaaaagcugauacuaaaauacuauucauugaggaggggaaaaucguucauacuagccuauugucagggagcgcucagcaugucgaggagugcuccuguuauccucgguauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauagaaaugacguguggaugggaagaacgaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45631 - RNA, 1410 nt, Artificial Sequence
  neuraminidase__InfluenzaA__ABG37442
augaauccaaaucaaaagauaauaacaauuggcucuguuucucucaccauugccacaauaugcuuccuuaugcaaauugccauccugguaacuacuguaacauugcauuucaagcaguuugaaugcaacucccccccaaacaaccaaguaaugcugugugaaccaacaauaauagaaggaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcgacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45632 - RNA, 1410 nt, Artificial Sequence
  neuraminidase__InfluenzaA__ABG37453
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaucggacccuauugaugaaugaauuggguguuccauuucauuuaggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaauuguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggggugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45633 - RNA, 1410 nt, Artificial Sequence; identical to SEQ ID NO: 45607
  neuraminidase__InfluenzaA__ABG37464

SEQ ID NO: 45634 - RNA, 1410 nt, Artificial Sequence
  neuraminidase__InfluenzaA__ABG37475
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcacccuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaacccaacuccaaauuacagauaaauaggcaagucauaguugaaagaggugacagguccgguuauucugguauuuucuccguugaaggcaaaagcugcaucaaucgaugcuuuuauguggaguugauaaggggaaggaaagaggaaacugaagucuuguggaccucaaacaguauuguuguguuuuguggcaccucagguacauauggaacaggcucauggccugauggggcggauaucaaucucaugccuauauaa

SEQ ID NO: 45635 - RNA, 1410 nt, Artificial Sequence
  neuraminidase__InfluenzaA__ABG37486
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaaccuuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagacaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45636 - RNA, 1410 nt, Artificial Sequence
  neuraminidase__InfluenzaA__ABG37497
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaaaccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgacggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauaauauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaauuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45637 - RNA, 1410 nt, Artificial Sequence
  neuraminidase__InfluenzaA__ABG37508
augaauccaaaucaaaagauaauaacaauuggcucuguuucccucaccauugccacaauaugcuuccuuaugcaaauugccauccugguaaccacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucagggagugcucagcaugucgaggagugcuccuguuauccucgauauccuggugucagaugugucugcagagacaacuggaaaggcuccaauaggcccaucguagauauaaauguaaaggaucauagcauuguuuccaguuaugugugcucaggacuuguuggagacacacccagaaaaaacgacagcuucagcaguagccauugccuagacccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45638 - RNA, 1410 nt, Artificial Sequence; identical to SEQ ID NO: 45095
  neuraminidase__InfluenzaA__ABG37519

SEQ ID NO: 45639 - RNA, 1410 nt, Artificial Sequence; identical to SEQ ID NO: 45095
  neuraminidase__InfluenzaA__ABG37530

SEQ ID NO: 45640 - RNA, 1410 nt, Artificial Sequence
  neuraminidase__InfluenzaA__ABG37541
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45641 - RNA, 1410 nt, Artificial Sequence; identical to SEQ ID NO: 45095
  neuraminidase__InfluenzaA__ABG37552

SEQ ID NO: 45642 - RNA, 1410 nt, Artificial Sequence; identical to SEQ ID NO: 45095
  neuraminidase__InfluenzaA__ABG37563

SEQ ID NO: 45643 - RNA, 1410 nt, Artificial Sequence; identical to SEQ ID NO: 45095
  neuraminidase__InfluenzaA__ABG37585

SEQ ID NO: 45644 - RNA, 1410 nt, Artificial Sequence
  neuraminidase__InfluenzaA__ABG37596
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaauuguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45645 - RNA, 1410 nt, Artificial Sequence; identical to SEQ ID NO: 45095
  neuraminidase__InfluenzaA__ABG37607

SEQ ID NO: 45646 - RNA, 1410 nt, Artificial Sequence
  neuraminidase__InfluenzaA__ABG37618
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucaucuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuacccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauga

SEQ ID NO: 45647 - RNA, 1413 nt, Artificial Sequence; identical to SEQ ID NO: 45332
  neuraminidase__InfluenzaA__ABG47810

SEQ ID NO: 45648 - RNA, 1413 nt, Artificial Sequence
  neuraminidase__InfluenzaA__ABG47832
augaauccaaaucaaaaaauaauaaccauuggaucaaucaguauugcaauuggaauaauuagccugauauugcaaguaggaaauauuauuucaauaugggcuagccacucaauccaaacuggaagucaaaaccacacuggaauaugcaaccaaagaaucauuacauaugaaaauagcaccuggguaaaucaaacauauguuaauauuaacaacacuaauguuguugcaggaaaggacaaaaccucaaugacauuggccggcaauucaucucuuugcccuauccguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaauuucugguccagauaauggggcaguggcuguacuaaaauacaacggcauaauaacugaaaccauuaaaaguuggaagaagcgaauauuaagaacacaagagucugagugugucuguaugaacgguucauguuuuaccauaaugaccgauggcccgaguaauggggccgcaucguacagaaucuucaaaaucgagaaggggagaguuacuaaaucaauagaguuggaugcacccaauuaucauuacgaggaauguucauguuacccaaacacuggcacagugaugugugugugcagggacaauuggcacgguucaaaucgaccuugggugucuuuuaaucaaaaucuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugaaacaggauaucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 45649 - RNA, 1413 nt, Artificial Sequence
  neuraminidase__InfluenzaA__ABG47843
augaauccaaaucaaaaaauaauaaccauuggaucaaucaguauugcaauuggaauaauuagucugauauugcaaauaggaaauauuauuucaauaugggcuagccacucaauccaaacuggaagucaaaaccacacuggaauaugcaaccaaagaaucauuacauaugagaauagcaccuggguaaaucaaacauauguuaauauuaacaacacuaauguuguugcuggaaaggacaaaaccucaaugacauuggccggcaauucaucucuuugcccuauccguggaugggcgauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaauuucugguccagauaauggggcaguggcuguacuaaaauacaacggcauaauaacugaaaccauuaaaaguuggaagaagcgaauauuaagaacacaagagucugaaugugucuguaugaacgguucauguuuuaccauaaugaccgauggcccgaguaauggggccgcaucguacagaaucuucaaaaucgagaaggggagaguuacuaaaucaauagaguuggaugcacccaauuaucauuacgaggaauguucauguuacccagacaccggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugaaacaggauaucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcaguauuucuuuuuguggcguaaauagcgauacugcaaacuggucuuggccagacggugccgaguugccauucaccauugacaaguag

SEQ ID NO: 45650 - RNA, 1410 nt, Artificial Sequence
  neuraminidase__InfluenzaA__ABG47865
augaauccaaaucaaaagauaauaacuauuggcucuguuucucucacuauugccacaauaugcuuccuuaugcaaauugccauccugguaauuacuguaacauuacauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcacccuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauucuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45651 - RNA, 1410 nt, Artificial Sequence
  neuraminidase__InfluenzaA__ABG47876
augaauccaaaucaaaagauaauaacaauuggcucuguuucucucacuauugccacaauaugcuuccuuaugcaaauugccauccugguaacuacugugacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcgugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagacagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugcuggaauccuaacaaugagaaagggggucauggagugaaaggcugggccuuugaugauggaaaugacguguggaugggaagaacgaucagcgaggagucacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45652 - RNA, 1410 nt, Artificial Sequence; identical to SEQ ID NO: 45617
  neuraminidase__InfluenzaA__ABG47887

SEQ ID NO: 45653 - RNA, 1410 nt, Artificial Sequence
  neuraminidase__InfluenzaA__ABG47898
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggguuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauuaguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccugaauccuaacaaugaggaagggggucauggagugaaaggcugggccuuugaugauggaaaugacguguggaugggaagaacgaucagcgaaaaguuacgcucagguuaugaaaccuucaaggucauuggaggcugguccaaaccuaacuccaaauugcagauaaauaggcaagucauaguugacagagguaauagguccgguuauucugguauuuucucuguugaaggcaaaagcugcgucaaucggugcuuuuauguggaguugauaaggggaaggaaacaggaaacugaagucugguggaccucaaacaguauuguuguguuuuguggcaccucagguacauauggaacaggcucauggccugauggagcggacaucaaucucaugccuauauaa

SEQ ID NO: 45654 - RNA, 1410 nt, Artificial Sequence; identical to SEQ ID NO: 45617
  neuraminidase__InfluenzaA__ABG47909

SEQ ID NO: 45655 - RNA, 1410 nt, Artificial Sequence; identical to SEQ ID NO: 45626
  neuraminidase__InfluenzaA__ABG47920

SEQ ID NO: 45656 - RNA, 1410 nt, Artificial Sequence
  neuraminidase__InfluenzaA__ABG47931
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugaaaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45657 - RNA, 1410 nt, Artificial Sequence; identical to SEQ ID NO: 45626
  neuraminidase__InfluenzaA__ABG47942

SEQ ID NO: 45658 - RNA, 1410 nt, Artificial Sequence
  neuraminidase__InfluenzaA__ABG47953
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacagugcaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcgaacaucaaucucaugccuauauaa

SEQ ID NO: 45659 - RNA, 1410 nt, Artificial Sequence
  neuraminidase__InfluenzaA__ABG47964
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccacaauguaaaauuacaggauuugcaccuuuuucuaaggacaauucaauucggcuuuccgcugguggagacauuugggugacacgagaaccuuaugugucaugcgauccuggcaaguguuaucaauuugcccuuggacagggaacaacacuaaacaacaggcacucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgguauccuggugucagaugugucugcagagacaacuggaaaggcuccaauaggcccaucguagauauaaaugugaaagauuauagcauuguuuccaguuauguaugcucaggacuuguuggggacacacccagaaaaaacgacagcuccagcaguagcuauugccagaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaagagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45660 - RNA, 1410 nt, Artificial Sequence
  neuraminidase__InfluenzaA__ABG47975
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuuccaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccgggauccuaacaaugagagagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagauccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45661 - RNA, 1410 nt, Artificial Sequence
  neuraminidase__InfluenzaA__ABG47986
augaauccaaaucaaaagauaauaacaauuggcucuguuucucucacuauugccacaauaugcuuucuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaaaccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45662 - RNA, 1410 nt, Artificial Sequence
  neuraminidase__InfluenzaA__ABG47997
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguaguguuuuguggcaccucagguacauauggaacaggcucauggccugauggggcggacaucaaucucaugccuauauaa

SEQ ID NO: 45663 - RNA, 1410 nt, Artificial Sequence
  neuraminidase__InfluenzaA__ABG48008
augaauccaaaucaaaagauaauaacaauuggcucuguuucucucacuauugccacaauaugcuuucuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaaacaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaagaaacgacagcuccagcaguagcuauugccggaaaccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45664 - RNA, 1410 nt, Artificial Sequence
  neuraminidase__InfluenzaA__ABG48019
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaaguaugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugccugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguaccuauggaacaggcucauggccugauggggcggacaucaaucucaugccuauauaa

SEQ ID NO: 45665 - RNA, 1410 nt, Artificial Sequence; identical to SEQ ID NO: 45626
  neuraminidase__InfluenzaA__ABG48030

SEQ ID NO: 45666 - RNA, 1410 nt, Artificial Sequence
  neuraminidase__InfluenzaA__ABG48041
augaauccaaaucaaaagauaauaacaauuggcucuguuucucuuacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggagacugaagucugguggaccucaaacaguauuguuguguuuuguggcaccucagguacauauggaacaggcucauggccugauggggcggacaucaaucucaugccuauauaa

SEQ ID NO: 45667 - RNA, 1413 nt, Artificial Sequence; identical to SEQ ID NO: 45380
  neuraminidase__InfluenzaA__ABG48052

SEQ ID NO: 45668 - RNA, 1410 nt, Artificial Sequence; identical to SEQ ID NO: 45247
  neuraminidase__InfluenzaA__ABG48063

SEQ ID NO: 45669 - RNA, 1410 nt, Artificial Sequence; identical to SEQ ID NO: 45359
  neuraminidase__InfluenzaA__ABG48074

SEQ ID NO: 45670 - RNA, 1410 nt, Artificial Sequence
  neuraminidase__InfluenzaA__ABG48085
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaauaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45671 - RNA, 1410 nt, Artificial Sequence
  neuraminidase__InfluenzaA__ABG48107
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaacacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45672 - RNA, 1410 nt, Artificial Sequence
  neuraminidase__InfluenzaA__ABG48118
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgacggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaacccaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45673 - RNA, 1410 nt, Artificial Sequence
  neuraminidase__InfluenzaA__ABG48129
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaaugacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45674 - RNA, 1410 nt, Artificial Sequence
  neuraminidase__InfluenzaA__ABG48140
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaauaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuacaggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45675 - RNA, 1410 nt, Artificial Sequence
  neuraminidase__InfluenzaA__ABG48151
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagacaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45676 - RNA, 1410 nt, Artificial Sequence
  neuraminidase__InfluenzaA__ABG48173
augaauccaaaucaaaagauaauaacaauuggcucuguuucucucaccauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaauaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuacaggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45677 - RNA, 1410 nt, Artificial Sequence; identical to SEQ ID NO: 44670
  neuraminidase__InfluenzaA__ABG48184

SEQ ID NO: 45678 - RNA, 1410 nt, Artificial Sequence
  neuraminidase__InfluenzaA__ABG48195
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugcauagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45679 - RNA, 1410 nt, Artificial Sequence
  neuraminidase__InfluenzaA__ABG48206
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucaacgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45680 - RNA, 1410 nt, Artificial Sequence; identical to SEQ ID NO: 45095
  neuraminidase__InfluenzaA__ABG48217

SEQ ID NO: 45681 - RNA, 1410 nt, Artificial Sequence; identical to SEQ ID NO: 45095
  neuraminidase__InfluenzaA__ABG48228

SEQ ID NO: 45682 - RNA, 1410 nt, Artificial Sequence; identical to SEQ ID NO: 45679
  neuraminidase__InfluenzaA__ABG48239

SEQ ID NO: 45683 - RNA, 1410 nt, Artificial Sequence; identical to SEQ ID NO: 45095
  neuraminidase__InfluenzaA__ABG48250

SEQ ID NO: 45684 - RNA, 1410 nt, Artificial Sequence
  neuraminidase__InfluenzaA__ABG48272
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggacccccuaucggacccuauugaugaaugaguuagguguuccauuucauuuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45685 - RNA, 1410 nt, Artificial Sequence
  neuraminidase__InfluenzaA__ABG48294
augaauccaaaucaaaagauaauaacaauuggcucuguuucucucacuauugccacaauaugcuuccuuaugcaaauugccauccugguaacuacuguaacauugcauuucaagcaauaugagugcagcucccccccaaacaaccaaguaauuccaugucaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgacccuggcaaauguuaucaauuugcacuuggacagggaaccacacuaaacaacaggcauucaaaugauacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauugguucaugguccagaaauauccucaggacccaggagucggaaugcguuuguaucaaugggacuuguacaguaguaaugacugauggaagugcuucagaaagagcugauacuaaaauacuauucauugaagaggggaaagucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuauuuccaguuaugugugcucagggcuuguuggagacacacccagaagaaacgacagcuccagcaguagcuauugccagaauccuaacaaugagaaagggagucauggagugaaaggcugggccuuugacgauggaaaugacguguggaugggaagaacgaucagcgaggaguuacgcucagguuaugaaaccuucaaagucauuggagguugguccacaccuaauuccaaauugcagauaaauaggcaagucauaguugacagcgguaauagguccgguuauucugguauuuucucuguugaaggcaaaagcugcaucaaucggugcuuuuauguggaguugauaaggggaaggaaacaggaaacuaaagucugguggaccucaaacaguauuguuguguuuuguggcaccucagguacauauggaacaggcucauggccugauggggcggacaucgaucucaugccuauauaa

SEQ ID NO: 45686 - RNA, 1410 nt, Artificial Sequence
  neuraminidase__InfluenzaA__ABG48305
augaauccaaaucaaaagauaauaauaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccucggacagggaacaacacuaaacaacaggcacucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgguauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45687 - RNA, 1410 nt, Artificial Sequence
  neuraminidase__InfluenzaA__ABG48316
augaauccaaaucaaaagauaauaacaauuggcucuguuucucucacuguugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacuggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcacucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugaaagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45688 - RNA, 1410 nt, Artificial Sequence
  neuraminidase__InfluenzaA__ABG48327
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucguggagugaaaggcugggccuuugaugauggaaaugacguguggaugggaagaacgaucagugaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45689 - RNA, 1410 nt, Artificial Sequence
  neuraminidase__InfluenzaA__ABG48338
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcacucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguguguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgguauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45690 - RNA, 1410 nt, Artificial Sequence; identical to SEQ ID NO: 45689
  neuraminidase__InfluenzaA__ABG48349

SEQ ID NO: 45691 - RNA, 1410 nt, Artificial Sequence
  neuraminidase__InfluenzaA__ABG48360
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugagugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaagcuuguagauaguauugguucaugguccaaaaauauccucaggacccaggagucggaaugcguuuguaucaauggaacuuguacagugguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagaucauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45692 - RNA, 1410 nt, Artificial Sequence
  neuraminidase__InfluenzaA__ABG48371
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcacucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgguauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45693 - RNA, 1410 nt, Artificial Sequence
  neuraminidase__InfluenzaA__ABG67138
augaauccaaaucaaaagauaauaacgauuggcucuguuucucucacuauugccacaauaugcuuccuuacgcaaauugccauccugguaacuacuguaacauugcauuucaagcaauaugaaugcaacucccccccaagcaaccaaguaaugcugugugaaccaacaacaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagcccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauugaaggaugguccaaaccuaacuccaaauugcagauaaauaggcaagucauaguugacagagguaauagguccgguuauucugguauuuuuucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45694 - RNA, 1410 nt, Artificial Sequence; identical to SEQ ID NO: 45372
  neuraminidase__InfluenzaA__ABG67149

SEQ ID NO: 45695 - RNA, 1410 nt, Artificial Sequence
  neuraminidase__InfluenzaA__ABG67160
augaauccaaaucaaaagauaauaacaauuggcucuguuucucucacuauugccacaauaugcuuccuuaugcaaauugccauccuuguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaguuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuugugucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauaguauuguuuccaguuaugugugcucaggacuuguuggagacacacccagaaaaaacgacagcuccagcaguagcuauugcuggaauccuaacaaugagaaaggggggcauggggugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45696 - RNA, 1410 nt, Artificial Sequence
  neuraminidase__InfluenzaA__ABG67171
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcgugguccagcucaaguugucacgauggaaaagcauggcugcauguuuguguaacugggcaugauaaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagacagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugcuggaauccuaacaaugagaaaggggggcauggagugaaaggcugggccuuugaugauggaaaugacguguggaugggaagaacgaucagcgaggagucacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45697 - RNA, 1410 nt, Artificial Sequence; identical to SEQ ID NO: 45617
  neuraminidase__InfluenzaA__ABG67182

SEQ ID NO: 45698 - RNA, 1410 nt, Artificial Sequence
  neuraminidase__InfluenzaA__ABG67193
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaacaauagaaagaaacauaacagagauaguguaucugaccaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcgugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagacagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaaaauuauagcauuguuuccaguuaugugugcucaggacuuguuggagacacacccagaaaaaacgacagcuccagcaguaguuauugcuggaauccuaacaaugagaaaggggggcauggagugaaaggcugggccuuugaugauggaaaugacguguggaugggaagaacgaucagcgaggagucacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45699 - RNA, 1410 nt, Artificial Sequence; identical to SEQ ID NO: 45617
  neuraminidase__InfluenzaA__ABG67204

SEQ ID NO: 45700 - RNA, 1410 nt, Artificial Sequence
  neuraminidase__InfluenzaA__ABG67215
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgguccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa
